United States Patent 12,790,634 (MOST PROBABLE NUMBER ANALYSIS OF HETEROGENOUS POPULATIONS) - sequence listing, part 32

SEQ ID NO: 21 - DNA, 5415327 bp, unidentified (residues 3,610,219-5,415,327 of 5,415,327)
  source 1..5415327: mol_type = genomic DNA; note = Faecalicatena contorta
ggaactggaggctgcctgtcgtaagtgtgtgcgtgtggaagtgacagacacgggtgtgctgtcaaaggtgctggaccggatggaactggagtatgagatcttgtctgagagccaggcggacatctttgccagtgtaaatgtaaccgcgctggtactggcgcttgcagaaatgaactgtgaagtgctgtccatgaatatccgtgatgaaagcctggaaagctattacgtcagtcttgtaggaggtggcagctatgagtaaacttttgtctgcggactttgcgagactcaaaaaagacaaggtgttctggatcggtatgatatttatgtttgtgttgggaattttaagtcctgttatgaactatatagatatgaatcggggagggtacgaaattcccctagagagttcattttttgtgtatgcgatctacatcgggattctgctgtcagcattctgcagcctgttcgtgggcactgaatatagtgatgggacgatacggaataaaattgtgatcggtcatggcagaattcaggtttatttttcgcactttcttatatgtgcagctgctgggctgctgatgtgtgcagcctattttctgccggcagggattattggaacctgtttgctgggattttttcagacggatattcaggtgattctgggattgattttgtgcagtgttattatgtcgctggcctttactgctattttcacaatggttgctatgctgaaccagaacaaagcgcttgtggcggtgatcaatatgctgggggtatttattctgctctttggggccatatatatccgggcaaagctctatgaaccaaaagtatatgagggttacgtatataaggacgaaagcggggaaatcgtggaggtcgaagaggagcctaatcccaattacctcagcggcaaaaagcgggaagtgtatacatttctctatgattttatacctacatgccaatccctccagataacggggatagaggcggtaagcccatggaagctggccgggtattctgcagcaatcaccattgtggcaacaggggccggcctgtttttcttccggaaaaaggatataaagtgagtactcccggcaattcagtctcaaaaacaggtgcaaaagagtgtccgggaatgctcaaaggaaaggaggatatgtcatgctctggctcagtattttatgtgcagttcttggaatcacagttgtcgtattgctggtcaaaatcgctctgcttcaccgggcggccgatgaaatacactctcaatttgttaagaagctggagaatgacacgaacaccctgatcctcctttctacccgtgatcgctatatgtgcaggcttgccgaagagatcaacgtacagctccgggaactccgtgcacagcgccgccgttttcagcagggggattttgaactgaaggaggcggttacgaatatctctcacgatcttcgtacccctctgactgcaatctgcggctacctggatctgctggaacaggaagaaatatcagagacagccggcagatacctgacggtcataaaagagcgttccgatacgttaaaacagctcactgaggaacttttccgctactctgtgatcacatcagtacacagggacgccaatgaggaagatatcatattaaatcacgttctggaagaaagtatatctgcatattatgccgctctgaaaaacagccggattgaaccgcagatctccataccggaagaaaaaatcaggcgcaggctggacaaaaaatcagtatcccggattttcagcaatattataaacaatgcggtaaaatacagcgatggcgaccttcatatcacgctgcgggaagatggtgagataatcttttccaatcatgcatcccggctcaatgagatccaggtcgggagaatgttcgaccgcttctacacggtcgaggcagcagataagtcaacggggctgggcctttccattgcaaaaatattgacagaacagatgcatgggaaaatcagcgcgcgttacaacaacggcgtgctaagtatccatgttcgctttgaagaattggaaattagttacgagaattagcgacgagctttagcctcggcgcggattgggccccctaataaccaaaatgccgggaagtgtgcccttaaaagctttctggggataaaaaatgcctccgatccaataccttaagctgcccccgtctaaggctccatcttaggaacgagtcttttcctgccggccggatgcgccagctccatgaagggatagccgaaggcccctagaagaacatacctgtaatgaaaaatcgcttaagcggaacttagtaattcttggcgggaaccggccatgaaaatggagagcttcattgattccgaatcaatgaagctgctgacccagcgcgagaaatcatcagatttcacgtgatgtgtcagcagtgctccatttccatggccggttcccgactagaattacttaggtccgtgtccgcgatttttcataacaggtatgttcttccgggggccttcggctatcccttcatggagcgtcctccaccccgaaaaaaactacgtccctaaatcccgaaaaatatctttgcaatgagaaattttgatgttataatagcatacatatgcagcaaaaaggagaaaatgtatcagggatacattacttgtgcggactatgtttggttatgtaacgatatgtgagcctgaactcaaggtaaaagatttaaggaaatatagagcatattactgtggactgtgccggacgctgaaggagcgcttcgggggcctgggacagctgaccctgacctatgacatgacgttcgcggttattttgctgacttcattatatgagagtgaaaccagattctccagccatcgctgcaaggttcatccagtgaaaaagcagaatatgctgcagaatgaaatgacagaatatgcggcggatatgaacgtgctcctggcctattaccatcagaaggacgattgggaggatgagaagaagataagcggttttgcggggtatcatgcccttaagggcagggcgcagaaggtggtaaagaagtatccgagacagagccgtgtgatagaggaagaactgaaaaatcttgcagactttgaaaaagaggcgacgcaggatatcgacaagactgccgggtgtttcggcaggctgatggcagagatgtttgtgttccgggaagacctgtgggagggaaggctccgcaagatggccttttaccttggaaaatttatctatatcatggacgcatacgaagacttggagaaggataagaaggccggatgctacaaccccctgaaggaactgagccggagggaggactatgaggagcggtgcaaggaacttctctgtatgatgatcgcagaatgcagcgcgcagtttgaactgcttccctgtttattagatgtagacattttgcggaatatattatatgatggtgtgtggacccgttatcgtaagatgcaggaacaaaagaagaaaagtgaggataatcagaatgacaaagaatccatatgatgtgctgggagtttctcagaatgcatcggatgatgacataaaaaaagcatacagggatctgaccagaaaatatcatccggatgccaacgtgaataatccgctggctgacctggcggaggagaagttcaaggaagtgcaggaagcctatgatgtgatcatgaaagagcgggagcagggcggcggctatacaggctatggttccggcagcagctccggcggttatggctacggctatggcggttcggcaggcggttaccagcagagcagcgggccccagaatgcagagatgcaggctgccgtcaattatatcaattcgaggcgctaccaggaagctgtcaatcttctgaaccgtatgccgcagcgggatgcacaatggtattatctgagtgcggcggctaacatgggtatgggcaataacgtgctggcaaaggatcatgcgggccaggccgtgaacctggacccaggtaatccgcagtaccgccagttgttaaaccagcttgagtggaacagccagaggtatcagaacaatccttacggaggcggatacgggggcggcagccagtcctgcggtacgggaaacctgtgctgtgacctgtggtgtgcggatagcttatgtgaatgtatgggaggagatctttgttcatgcatgtaaaggctaagaaaatggcttttggaggactgctgctggctttgacaattgtatgtatggtgctgggcagcgtgatagaatctaataccttatttcttctggcggcggcatcctatttcgtgggtataattatccgtgagacgggaatgcggacaggggcggccttctatatcgcggcggtgctgctcggatttatcgtggcgccgaataagatttatgtcgtatcctttgcggccatgggcttttatatacttgcggtggaacaggcgtttgtgatgctgggccggactaaggccagggtaaacagaaaggcgttgttctgggcgattaagtatatcatttttaatattttatatattcctgcgctgatcgtgttccagcagcttttgttcggcaggaatctttccccggcatggatggcagggctgattgccgcagggcaggcagggctttggatttatgacagggcatatgattatgtgcagagacatatatggaataagctgcgaaaacggcttttttaggtatgataaaattaaaaaaagagatgagtattcattcccggtatggcagaaaagtacatatcggggatttttttgcttattttaaatccttttggttataaacaggattatatagagagtaagacgttttacaaaaagagaaagggggaagcgttttgtggaggacagggaactgatcaggcggattcagaatgggcagaaggaatatctgaatgaaattgctaaaaaatattatgatgacatttactatttctgctgttatcagaccggcagccgggaagacgcctatgatctggcgcaggagacgtttctccgctttatacggtacgcagagcagtacaggtacagaaatctgaaaggctatctgctgacgattgccatgaatctgtgcaggagatattttcacgagacagggcggacgcgcctggttacggaaactgtgggaaatatcgaggggaatgtggcgggatccggcagggcagcagccggggataaacctgcattggaggggccggaaacggatactaccgtacaggccatggaggcgcttgagcagagccggctgctggcggaagcgcttctgaagattccggatatacagcgtgaggcagtccttctgcatcacttttatggctataaaaaccgtgagattgcccgcatgaccggggcatcctgtgcagcggtaaagtccagggttaatcagggactcggcaagctgcaggagcttttggcgaaggaggatttttatggatagacgaacggaatgggaatcctggagatttccgctggatgtaaaaagaaagaaggaaagtctggggaagattggccaggctgtggaaaaaaagcagatccgcaagtatccgtctctggcggcaaatatccgaagccagtttaagtttcagtcgtggaagtactgggctttgcagggcgggatacttgtggcagccatggcgctggttctatatctcagcagagtagaagcagacggagagggagccatctctgtctgcgctgtatttctggtgtttgccggcaatattgggttgagcggcctgggccggcttttctcacggaatatggctgaactggaacagacgctgtatctgaacctgaaacagatggtatgtatccagatgctgtttggcggggccgcagatcttcttgtattaggaatgattgtgggtattgcaggcggacaaaatgaagccggtgccggagcctgtcttttgtatatgctggttccttttctgtggtcagacttactgtatctgtatatgttgaccgcattccggagtatttggcctggtttttggcaggtttcggcgggattgatcggcggactgcttgcgcttatcccggtgttcctgaaagatgcctataaggcggtatatttgccggtatggggagttctggcggctgcaggctgtctgctgctggcggcggaaattctctatatgttggaaaagatagaaagaggggaaggattatgcctgaattaatattagacagggtgacaaaacagtttaaaaataagattgcagtggataaagtatcgcttcggttaaagtcaggagtatacggatttctgggggctaatggtgcggggaagaccacgctgcttcgaatgctctgcggcgtcctcaggcccacttcgggtgatatactatgcaatggtgtaccgatacgggttctggacggcgagtaccgttgcatgctggggtacctgccccaggattttggctattatccggattttacggcaaagcggtatctggaatatctggccgcatgcaaagcggttccaaaagagatcgccggagagaaggtacaggaagtattggaactggttggactgaaaaaagagcaaaagcagaaaatccgaacgttttcaggaggaatgatccgaaggctggggattgcccaggctcttttaaatgagccggaaattctgattttagatgagcctacatccggcctggaccccaaagaaagaatccggttccgcaacattatcagcgcgttgtccaaaagccggattgtagttctgtccacccatattgtctccgacgtagagttcatagcggatgaaattcttcttatgaaggcaggatgtattgtagaacagggatcaccgggggcggtgacggagagcgtgaaaggccgggtatgggaatatcgggcggatgaagcagaggcgctgcggatgaatgcggcgttttcggtcagcaacctaagaaatgaaggggacaggatctatctccggcttgtctcagaaacttgtccctgcgagggagcagtgccggtacaacccgggctggaggatgtgtatatgtattactttgaggaggcgtcggatcatgtgggaaatctggaaaaaagagatatataaaattgcatcccggaaagtaatctggtgcggtgtgcttttactccttgcctttgtaaccttccgtctttacgctgaacagaaagactattctgtaaccattgacggacaaagttattatggaaaagaggccattgaaaaggaccgggagctgacagcagagtatgcaggaatcctgacactggaaaaggtgcaggaaatctatgataaatacggattctattattatgatgataaaacagaaagcaatgcaggaaacttctgcagcaaatttgtaacagagcagatgacgaattataaccagaccagcgggaatgatccgtcccaaatccagttttacgagggcgaagagtgggaacaaaacgcagagccgctcctgaaagaaaatcttcagtttgactatttctatggctggcaggatttccaggaaatttacggtatgatgggcatcctgttattatatgtaatccttatcatcgggctttctccagtatttgcggaggaatatacactgcggactgcggacatccttctgtccacacagcggggaaaaaagagctgtatctgtctgaagattgcagcagcgctttcctttaccgccatggtatacctcatggtaacggcatatatctggttcatttatctgctcgtatacggcacacagggtttggatgcctcagccgtcctggcgggagccagctttttcggttatggccccggcagcatcgggggattccttctgtccatgtcggccctgggcctggccggagggctcctgctgaccggatgtgtcctggcagcctcttctctgtgcagaaattccttcctaaccgtagtcgtttcactatccctctatctgacacccgtagtctggctcaaagtctttgcccctatgtggatactaggatacagcctgacccgtgcggtaaaccacttcatggcatctatgcccttctacctccccatgaactggagctttggattcaccgccgcccagatccgatggcatctgctaaccgcactggccgtcgccgtctcctgcctgatcctggcctaccaaaaataccgaacctaccagggcagaaaataacagagcccgcaaattaggaagataccttacaacagtcaattttcaatcacacgcttccctcatttgtgtaagtgacaaccccagattcccattccaaatccccctctttatttccagagttttttcgtgtacaataagacggtatggaggtgagaagagatggacaggcacaagattttaattgtggaagatgacaccgacatcaaccgcttactgcagcggattctggtgcaggacggttatgatacgatccaggcattttcaggtacagaagcgaaactgctgcttggactggagacacctgacttaatattgctcgatctgatgctgccgggtatgagcggagaggagcttattacatccgtaagaggggagatgaatctggacctgccaattctggtgctctcggcccgggcaggcctggagacaaaagtagaggccctcaaaggcggcgcggacgattatctgaccaagcctttcgaaccggaggaggtcctggcaagagtgtatgctgccctcaggcgttataagatagaagccgggaagacagagaaggatacggaggtatacaggtataagaagctgagcctccacccagactcccgtaaagcggagattgagggacaggagctgtccctgactatgcatgaatatgatattctgtatcttctgattaaggaccccgaaaaagtgtactcaagggagaacctttatgagcaggtatggaagggcggttattacggggaggataacacggtaaacgtccatatcagtaatctgcgcagaaagattgcggcagccgatccggaggatgagtacattcggacagtctggggaataggttttaaaatggcataaactttacgatttctttaaactttcttgaggacttattaaagaccaccgagctacaataacttacgtcaagaggcaatcacattaaggaaggaacagagaagtatgaaagagcatgtcatagaagccagaagcgttacaaaaaaatacaaagatgttacggctctcagagacgttgatattacagtcaaacgcggagatatttatggcctgatcggcgacaacggggcgggcaagactacatttttaaaactgctgaccggacagatctatacatcaggcggcgaactgaaactattcggggcttattccgaaaaggaactggaacagaacaggaaacgtaccggagcgatcgtagaatcgccgggattttatccaaaacttacggtagaaaagaatctggagtattaccggattcagaaggggataccgggaaagaaccagactgaggaagccctgaaggcagtggggctctgggacaagagaaaaaaaaagtgcgcggcgttgtccatggggatgaaacagagactggggcttgccatcgcactgctcggtgagccggagttattgatcctggatgagccgatcaacggactggatcccagcggcatcatagagatgagaaaccttctgttaaggctgaatcaggaaaagaatattacaatcatcatatccagccatatactttcggagctggaacaaattgcaactgtttacggctttttaagccagggctggctgcttcgtgaactgacagcggagcagctgcacgaacactgtgccggttatttggagatcaaagtaagtgatccagaacgctacgcagcgctattggagaaagagatggacggcgtgcagtacaaagtaatgccggacttacagatacggatacagaacccgcagcttccggtggaagcatacagcggtctggcatccggacatggggtcagtatcatgaggctggagcagaagcagaagtcgctggaagagtattatatggaattaaaggagagggggagactgtcatgttaaattatttgaagagtgaattttacaggattctgcatggaagagagatctattcggcaacggccgcgctggccggcctgactgtgctgatgaatctggttctctttgcctttgacaggctgactccggattttccatatgcaacggtgacattttctttgaacatgatgacgggcagtatgccgatgctgcttatggccggcctgatcatcgttctctttttgttttcggacgaatataagaatggtactctgaaaaatacaatttcatacggtatttcccgcaatgcattttttaccggaaaatgtattgcatgtgcagtggcagcttttttgagtatgcttgtggtcctcgccgtttatatcggcagtgcatatctgcttttgaatgcagaaggcagtatgccagtcagacagctgctgacaggtacagccgtgaatctgccggctgcatttgcttcggttattctggcatcggctctatgctgccgttttaagaaagaaacagcggttgttctctggtggctgggaatcatatggtggctgcccatggtctgtttttttctgggcctgaagatagaatctattgaaagaatttctgaatggatgccctggaattacctgaaatatgaggtatccgttaatatgtcaggctacagctgcctttgggatacgccggaaggagtagccaaatgcctgatagcaggctccatcgggatactggtattctatgtggcaggtatcttggtctttcacaaaagagagatcaattagatctgggaggtgcatgtagaaatggtatatatgttattagcaggcgcatgtcttgcggcggtatatttctgcatgcgtttactgcttctgaaacgcgcagtccggctggcagcaggggaactgcgtgagattaccggagatctggaagaaaacagggtggtaaagctggcagtgccccagagggaactggaggaacttctggaggagattaaccggaacctggcagagatccggaaagtaaaaatccgctataggaataaggaacgggaattgttgaatcaaattgagaatatcagccatgacctccgtacgccgcttacggctatcatcgggtttttggagctgatcgacagggactctctggacgttgaggacagagagtccctggatgtggttaagaagaaagccctggcgctgaaaaagctgaccgcacagttttatgatctgtccaggctggctgcggaggactaccagctgaaattgaagaaaacggatttaggcaggatattgcgggaggcggttctggattcctatcaggaactgaagttaaggaatctgaatgtcaatgtggacattccagatactccggtttttgtaagggggaatgaggaagcgctggagcggatcttccagaatctgctgcaaaatgcgggacgttacgctgtaagcgtctttttcgtaagtctgactattgagtccggcaacatatttgtccggatggtaaacgatacggatatggcggatcaacaggacgcagattctctgtttgaaagattttatacaggggacagcgcgagaaagcagggaagtacgggcctgggccttcccatagcaaagcacctggcggaggcgatgggcggaaggctgcatgccggcttgaaagaagcagaagaaaaaaactggctgtcactatccctggaaattcctggattgaagatataatacaagcaaaattacggaaagtatagtataactaacaataggatatccaaaaaagatcgtgaggtaggacattatggaaaagaaaatgcaatggcgccatgggtgcggaaagcaggaaggaggggatgcatgatgcaaaagataaatggagccggacatatagcagcgttatttacaattattgtgtgggggacaacgtttatttctacaaaggtgctgctcagggattttcagcctgtagaaatcctggtgatacggtttgtaatcggctatctccttctgctggctgctaaaccgggctgggtgaggctgaaagaaaagaaacaggagtggctgtttgccggagctggtttatgtggcatctgcctgtactttctgatggaaaatatagcattgacttatacacttgcatcgaatgtaggagtcatcatctcggcggctcctttttttacggccattttgacgcatatttttatgaaagaagagggcaggctgcggctgtcgttctttttggggttcggagttgcgattggcggaatctgtatgatcagctttagcggtcaggattttgcggtgaatccgacgggggatctgctggccctggcggccgcctttgtgtgggcctgctactccgtgctgacgaagaagatcagcagctatgggtatccgatgatccagacaaccaggcacatcttcgggtatgggattctctttatgatcccggccgcttttgcgtttgactttcacttgggaatcacaaggtttctggagcctgtcaacctgctgaatattctctttttgggagcaggggcatcggcagtctgctttgtgacatggaattttgccgttcaggtactgggagctgtgcggactagtgtttacatctatgtggtaccagtggtgacgattgtcacatctgtgctgatccttcatgagcagctgaccgggatggcggcagccggagcagtgcttacacttctgggactgattatttcggaagggaaaatagagctgaaagtcttatttaccactagaaaacaggatgctatactaaaaagagaaaaggaaaattaggaacatgaaattttatttggcgcctttggaagggattaccgggtatgtataccgtaatgcctatcataaatatttcggagagatggataagtattttattccttttatcagccccaatcaattcgggcatttaagttcaaaagagaagaatgatatccttccggaacacaatgagggaatggaagcggttccccagatcctgacgaactcggcggaagattttatcagaacagccgggaagctgaaaaagtatggatacaaagaggtgaatttgaacctggggtgcccttcgaagacggttgtatcaaaggggcggggctccggtttcctggcatttccggataggctggatcgatttttaggggagatatttgcatacacggatatgggaatatcgattaagacaaggattggtaaggatagttcctgtgactttaaggaacttctggatatttataatcagtatccgataaaggaactgatcatccatccaagactgcagtcggatatgtataagaacacacccaactggcaggtttttggggaggcactggacagatgtgagtgtcctgtgtgttataatggagatatttttaccgttcaggacttcaagcggtttgcagaagcatttccggaagcaggatgtgtcatgctgggacgcggcattctttccaatcctgggctggtcaattccattcggggaagaggagcgatggataaggagacgctgcgtgctttccatgaccagatataccgggattatcaggagattctgtatggggagaagacaattttatttaagatgaaagaactttggttttatatggcctctgtatttaccaattacgcgaagtacgcgaagaagattaaaaaatcagaaaggctggcagtgtatgaaagtgcagtggcagctctgtttgatgagcaggatatttttacaggataaggagatgcggatatggaaagatatgtcagacttgaagaaatctcggacggaaggctttacgggccgaatgatatggtgcgtgccgactgcgggggatgcgagggatgccctgcgtcgtgctgccgggggatggggaataccattgtcctggatccgctggatgtattccgtatgacgactgctctgggtgcgaagtttgaggagctgctgatagacaaaatagagctgaatgtggcagacggactgattctgccgaacttgaagatggatggggagggagaaagctgtgtttttctgaacagccagggaagatgcagtatccacgatgcaagaccagggatatgcaggatttttcctctgggaagatattatgaagacagagactttcggtattttttgcagactcatgagtgtttgaaggaaaaccgtgcaaaaataaaggttaaaaaatggattgatactccggaactggagaaaaaccagaaattcattgcggattggcactattttctgaaggatacgcagtatatgcttcagaagccggagaatgaggcgaggagaaaagaaatcagtatgtatatattgacgagcttctatatgatagagtatcgggaaaatgaagacttctatgcacaggtggagagaagaatgaaacaggggagggagagtgttggtacgggggcgttttagaaagggcctctggcagaatgcgggattctgcgtgagccggggactgaggtaattaaggatagagtgtaaaaggaaacccaaagcaagtaagattttggtgctgtgggcttccttttctctattacttccggcttttggcatgtaaaagcgattcaggcaaggagttcatatattcccagggcggccagaatcaggccggagatgaagtcggcggactggtcggatatgtgtgggacttttgttttaccaatcaggttgcctgcatataggaagatgacggacacgaccagggacatgacagcggtagggagtaatttcagtcccgttatgctggctccgatgcccatgccgaagttattgatggataaggcaaggccaaggaaaagcccctccttcatggtaagcagggaggctttcgcaggtacattgttttgggttccggaaccgcattcgttcgactttacttcagcctttttgattttttcccggatatagctgaaaaaagattttatgatatagtaaaggccgagtccgatcagaagagcacatcctatggcctgtgtggaagaggccggcagaaactgtgagatttgtgtgcccatcagtatggcaatcacggtgcctgtcagtgtcacgaggctgatgacagtgctctttaaaaggtcgatattggattttttgattccataggacataccgacaatgaagctgtctatatttgcagaaattgcgaatagaagtgatgagattagatgcataatctgctcctgacatcataattgttgtttgtattcagtatattcagaagtatttgttgcgttcatggcgcataaactattaagagtttatcctggaaggcgtccaaatttatgcgtaaacgattgatttccccgtttgggattactgttgaaattctgctgctgtttctggttctttctatctggcaggccggggatgcagacggagagaacgggtggaagataagcagaggaggtatttcagacagcatttctgtcaatgcacaaagcggaacaggaaccggctattgggagaatgaagtacagagagaggagacggagcaaggggagacacaggaagaagatacacaggcagatgattcacagggaaagaacggacaggatcgaaatacgaaggaagaggagaaaaaagactttattaaatgggtggaatttaatgtaacttacgaagcattgaacagggcctatacatatgatgtggaaacctatgaggaggacgtccatctgagctgggtggagcttctggcctacctgggcgcgaaatacggtggggattttacacgttattcggagcgtgatatgacagaagctgccgaaaaactgttgtcgggcgatgtgaccatggaagaactgactgcaggcatgcagtattacgggtattaccgggaagcgtacggagctgtcctggatggaatggtaggcgaatatgagattgaacggccggctggggaaggggcagataaaaaggtctggaaaaagtattacggactgaaagcttactgtccaattgcgaagacatttccctattcggattacgacgacttcggggtgtccagaagctatggttatcggagaaaccatctggggcacgatatgatggggcaggtgggtacaccaagaagaaagatatgcagaacctagaaagagatttctaggttcttgtcatttaacacgcatctctttacagtgcgacgaataagctcgtttttttctttatatgccatgtcgtcgaaattgtcaagtaagtaacagatatttttatatatttcttctcgttcttctgtttctgatcgctctttattgtcccgtaattcctcaagttgtaactggtttttgagagtattaagttttttatcaagattctctatttgctggacaatatactttgcagccgttgaggtcacattttcttggagctggcgggtcaggttctcaagtgcggattcggtagagcggatatcctttttaagggcattgatatcggtaacactgtgctgattatgctgcggatgcacaaattcctcatcaattcgaattgctttcagcttatctataaaaagattgtcgatggtatcaattttcacaaaatcagcgtcacaataatttattccttctctgtccctggcaggacaaaaatagtaagcaaacattctctgattttttatatacacacggttctgcatagtccttccacatctacattttaagattcccctcaggatcccgacctcatgttttagtgtacggacttgcttattttgtccgaggcgttcttgtacagctatccaatcatttgcaggaataacataatcatggatgcccagggctatgatccatctatccatatctaatttcttcttgttttccgttccctgcgtgcgtccgtagccgataagcccctttgtcccgtcaaaaagtctcttatcagggagagtgcagcccttgccatgtaagtaataaaatgcctgcaaatcagcttggcagtataccgggttcgtcaaaatcccgtatatctgtgaggtatttaaaaactttcctgtctcactggtaatactatgatctcggcagtatctctctacccgggtgatagggtacccttccaggatcagttggtagagcagctttacacggcctatggtttcctgattgactataaggtaagagtgttctttaccatccaccttctttcgaatggaggtcattccggaaggaaggtgcccgccagtccatttcccagaggctcctaactgcttcatattatcgcctacgcgctctgacgtgttctcacgctcaagctgagcgaaggcagccagaatatacattactgtgcgcccgatcggcgtggaagtgtcaaaagactctttcacagagacgaaagaaacgtcatgatcctgcatggtatcgtacatagcggagaactcttttacattacggctgattcggtcaagtttatataccattacgacatccaacttattcgccttcacgtcctgcatcaactgctggaaagatgggcgattcgtattctttccagaaaagccctcatcctgatcatatatgaaaaactctaattcttcaccgcggaagatgatcccagcataatctttacacatttttatctgcacagcaactgagtcgctgttatcccggtacactgattttcttggatatatccctattttcatatcacagtcctccctattgcattgtattaattttgagtacaaaaaatacacctatacaggtgcagaggatttatgatataatctgtgtgtcgggtgattatatcggctgctctgcggcctgtatagcatctatataagccgttcctgttggcgcaggggcggtttttgaaattatgtagataacgtaaaagaccccgtatttctacgaggtcttcataatgaatactgctcgccagttgactgggagctgtgtcttctatactgccggtaaacggctttgttttctttgcgtattcattatatacctcagtgtatgtaattgtcaataataatatgcttatttctgtccagtaaaattgtgtaaaatttctgaatcaattaaatctagtttttcggtggaaagttttacattgcttaaaatatcaaaattcgtctttgggtcgtatattctaatcttgcttatagtgcgaatttgacctactaacgcaatgcttccaatcttcatctttgccacttcatctttcatccgattgagtaggacaagttcctgtttacaaacatctaagtcacgttttatattagctaatgtgtcatcaggagtttcttcattaagaagtcctattgtttccttcaattccaccattctggccagaaacgttttttcagtgtaagatatcttggaacttaaatttgtgaaaagttcattccctaaatgcacattccctctgtgcagatgcagcaagtcggttttcttttttacggatgtgagcggaacaattgtaagtactggtgaattcctcgaattgtttttatcaatgacgacacaatagtggagcccaccttcttcgctcccgacattataacccagatgagccttgataatttccccacgtttatatcttcttaagctagctgatgaaaactctggctcgaaatcaaggaaagtagtccaatcctcaagccaatagctaaacttatcagcctttccgcgaattttagcatcaggactttttataagcgaatcaatataagactctaatctacataaagctgactttttatgctccagaagcttttctgttgaaatattccttcccattaatttccctccttttctttggtttccaagaaaacaccacatctatgttaagccatcaggcgtaatatttgactattgtctcccttattggtgcaaggacattgttaaatcgcttggttttgcagtaaaatgaaattcgaataaagaactgtcatattctgatcctactaagccattaataaaatcagcagttgcttgtccaaccgcctcggaggtgctgtctttctcctgcattgttgtgtaatgggtaaaaatgttgttccactcttcctcggttcccccataatataattggattttttcaccttcatcaggatgaaaataggaaagagtataatcatacataacagtcatagttttggggaaatacacacttcttacatcgctacagttaaatgcgcctgtattaagatcagtaattccttcagccaatattactgtttcaactttactgcttgaaaacaatgaaaagtcaagtagtgaagtagtatattcgataccatctatcgtatatacattattgatgactaggagctcatcatctccttgatatgaatttagtgatatcttattatctttaatttcatattcaaaatcatcaatgctgttatatgctggttctgcattcacagcagttttgtttaatgattgtgaactttcattgctatttgtatctgcaacagccatgtatagacccagaataaaaagcaatatgagaacaataattacgaccacaatgactatagctttttgcggagattttccgtcttgaatttcttcattccagacaaacccgcagtcattacattgaaatttaacattagaattatttcgaatttttatattatggctgctacactttggacatatattagtattataagaatttttggtgtattttttgccacaatatatgcattcgtcaatagctacgggtaagggacgtccgcattgataacaattaaacatttgggggcgctggtcttccggcatttcttccacttcatcagggtctctgaattcggaagcaggacaaccgcaattaggacatttatacgctttggtacttatttttttgccacattctgggcatttaattaatgccatatgatccctccctctatctgtacctaaacaccacattatgttaagccgtattttgcttaatcatctaaatcatcatcatttatttgtaatggatagcatttcagttcttcatcttcaagttcgaatgatagtccaattaggtcgtttatattttccctgattaatattgggtcttgtacttccatatcttccataatacctgtctacaatgtatcttgggtccgatagtattcgatatattttttgaatcttccaattaggatttcctctatggcagatatttgcttaataaatctaccaaataatttgtccctttttaattgccgctctttgtataatgcatctctgaaatttaaatgggtagctctcataatttcatcgttattggtgattccacattcctccaaaataatatttggagcacgcacacaacgtgaaaactcataaacttctttttgttcatcatcaaccgatatccaagcatcagaagagaccatctgaagttcaacgtatgcaattgatgcagcaacagtgttcagaagcacataagaatcgactttagtgtttataaaaatgttataatgattatatatagtatcgtagcatataaaggcatttccgaatatttcccgtaatacttctgcattgacgttatactttcggttagcataataatatgaataaaaatacactttactttcgcaatcaataatagaatttaaatctattggcaattttctgcaattggaacgcacaataagatcatatgctagtttgcgaattagttcctgattattatcgttagtatacattaaaaacactccatacagtttatttaatatcagtgtaacatccgtaggagttttgttaataatccaaaatttggtaactaggcttttctttcttgccttttttgatctcacgcataaatacggaatcgaattcaggtgacgttgggactgtatcgaaattcaatttgcttatatcatcttcatcaatcgatttgtttgctaatgtatctattacgcgtcctacgcaacgtatttcttctgtaaacggaatattatcatattcatcattgacagagattagttctctattacccaattttttaacaagagattgaccatcaataataaatatacctatttcattcctatgaatctcgctggttggttctaccagaagagtttccccatcattatactgtggctccatactttttccgttaacccctatagcatatttaactttcttataccttggaatatctggtatttctaccaaatcaacaggaatatcatcaaaaacaatctgtccagtaccggcagaggcaagacgctgataatactgaatgtgacgtattttttcagattgtatggattcaagttgaagcttttctgactcagatcttttccattcttcttcgagtgtcatatcgaccatttttttgccatgatcatctaaagcgcggtattttcttattttattcatttcagttatagttacttcgtcatcttttttgggaagcgcagcttgtaaaaaatatgatgctgacacattcagaattccacagatatatgaaagtgtatctatatcgggcttgctcacattattttcccaattacttattgtatttcctgttgtgtttaattgtttggcaagttctgcttgttttagccctgcatcgagtctagcacgcttcaatttttctccaaatgtcaagtatatcaccttctttctatataacgaatatactacaacgcctcttggaatttgtaaatgcataatcacaataatattgaggcgtcacagggaagcatattgacacaccaataatattggtatattattctaataaatacaatgttattgggcagagggggtgaataataattaatatagtattataaaggtaaagaatttatgtactttttagtggtgttttcaggagggcggtactatggaagaactaaaaaaagagattattgcaatgattaacaaaatttcaaatgaacattatttgagacgactatatctcattttagttgtcattgcagggactgaccattaggccagtctcttttttactcaattcctaaacaagccttcataaattcttctatatgttttaacttctctggggatgcctcagcaatggcattcaacatattctttgcaatctgattttctgttattgtcaacttccctagattaatagcatacctatcgtcctcagttactttggcgaacatattatcgtctccgccctcaccagttcggaaccaaacttcgtttataccaaattctttacatattaaggattgggctgagccactcggattcctacgtccagtttcataaccagttattgtgttttggactgttcctaatttttttgcaaattcttcttgagtaaggccgaaatattttctgattttttttatacggtcttttaactcttcatttttcacaatatcacctccatctctaaatagaactatatcaaaaaaaaaccgcattgtcaataaaaaagtgattgacatataccgcaaagaagtatataataaccgcatagacaatgaaagtggggtgaaacagatgcaagaaactgtaacaatagtgctgataattttaattttcattatacaggcttatctcttttttacgaacagaaaatgaattattgatccaagaatgtggtttcttctatgcaagagagactgaacacatcatctttaaggtcactttttatttggaaagtaacatcaccagaattggtaaaaagtatttcttcattttcagagcaaataaacatgatgaatattagtttagaacaatgtccgtctaaatgaattggaaaatctgatgtgaaaaactggtaaggcctttccaaccccggaggaataaagtgttctttcaaaattctgtgagtgagggtgcacctaacatatgcgccacctttgcatagagcagagatatacataatattcacagggttcgatgataggttttccacaaaaaatccaaagatatactcgcgatatgaagaattaaattctgattttattatggaatatccagtattgcttattttaaggttgtatcgtttatgccagaggccaaacaatagttgcccagaagatagaagaaaccccactacagcaataaaggtagtgatattgtcctgtgttaacaacctaggaacattctttatggcttctctaatcattgaataatttctcctttctttcatactcggcatggcagtgcctgtacacacattataggggatacgtagctaaataacaatactaccatatgagggaggtgagaacatgacaaacaataaacccgaaatcaaacttacagaagatacagtagaaaacatcaaaatcatggctccataccttgatgaaacttctcaaaaccgtgtgtttggaatgatgctggaggcagtcaaaaatctgcctgatgaagatactgattcaaagaaggcaggatagagaggaggtggataaaacgaacggaaaaagagatgttgatttctggattacttttgttgttggatttgcaattagcctgctggtagcagttttatggcagttactcaattaaaaaataaagtttatatgggaggagaaataggtgaagaataaagaagaaaaaacaaaagatttaagagctaaatgtaacaatattttttacgataaagacagcaggaaagaaatcgaagaagctattactaaaaaagcggtagaacttaaaggggcaagtgaagcgagtgtattaagagtttatgatgttttggctttacaaatgaatgaactccaaagacttaacagaacaatggagtccatttttgaaattattcggagggctgaataaaaccaatagtccttttgggccgatctgcttctttttcaatagatgtaagcaaaaagtttaattggctgacatgttggacgagagtagacattttcccattgacataacctttaaaaatcataagaacagattcttcataacttatttcagttacttgcattattatagattgcccaaagtttgttaataatagaccaatttcatgatcggcatcaagtgtttcttcaaaatcacgaatatacttttttaatatttcaaactgggtatctgaataggagtatgcaatcggaagaggacctatttctggaatgtttaagttttctaagttaaacatggtgttaattctcctttcactaatagttggcagtggcagatgccaatatttaaagtataggatattttaggtcaaaagacaagaaaagaaatatgtaagacaaatttcttaaaccgcggatgccagatgaataggagagaggtgaggaaaatgaaagctccacatattgaaatcaaaacaaataactgtcggacagaagtatttgtcgatggggaaaaattggatggtgtaagaaaagtaagtttcgagcgtaaaggcggaacagcaccgattttacacattgatttaattgcaacggatatgacggtagatgcggttatgattccgatattgccagaagtgtttcgacctttttacgaatcaaaaaagccatccgaagatgactctaatgtttaaaggctctgtggtgcagatttgataataggacatttggatgaatcacattcatctccatacatattgtaatcacaattcgcaatacctttttcgtaggatttctgggaaaaatccgatgtatctatgtattcaatggagattgtgtgatctttgccttgtgcaggacagtaaccagtgaaacgcttttgcatttgatacacaccctttctttaataggagtgtatcacagaataagaaaaatagaaagttccttagtggttggactatgcagaaaataacgtgaaattttatttagatattcgattaaatacataatagccatctaccgcactacaagcagatgactattagcagtccattgtataccatgagattgaaacaacatccggcgctcagaggcactcacacatattcgcgactatgtgtaaccggacttctgtgacataggtagtgcgtcacgttgtgacaattgcgattcttatgtggtagacacccacagcccaaagcaaacgcttatcataataattggcggttacaccttttattattcatcatggtgcttggattcgacattaagaaagctatgagcttttccaaaatgtcaaccccctttcggaacgggctaattaaattacatcgaatatctaaataaatttcaatatattaaccagaggaagttatttagaaaggacggtgaaagatgtatccaattttggagagatgttttcgagcagaaacgaggaatacatatgaacgcagaaatgttagaggaaggagagtagtgaagaatggcaagaccaagaggaacagattcagcaagggttattcaggtaatagaaactatttctattcggggagaaggaacgaaagatgatttgtgccggccaattaaacagtattgggactttaatgggaatctgattgcagagaacgatgattgtataaaagaaaaagagtagtcgcctactcacttttctttctctcaatttgtttagactgatcaattccgatgatatcagcgtagagttgttgttgattatgacgttcgatataccattgttgtaataacagttcgataagtttaataagcttttcggcttcagatggatctatgtttacaataaggtttatgtctttttccatgtgggcgccgatgttgccaatacgacgaacaccatctaatacagcccattgatccgtaggaattttatcttttatagcatcgatctcttcaaaaagactcttttttgatactttgaagaaatcacgaatcattccttggagacaacggcgggaaagcgttgcggaggccttggggctaagattcacaattgcacaagcttcttcgtaatcatttcgaatagctttaggaatatagtcagggaattggattgctaaagacaatgggaagatgggaattgtcttttctgacatttcgtttccggtatagtcagcataactcgtgattttatcgcaatttggacatttgtacattcttatttttaaactatagtcactatctagtgtgtgaccaatattacctgcaggtgtacggaattttacatcgctagaagtaaatgttccggttattacaggaattgtatgattacaaaatggacatgtgaagatttcagacataatattcatccctttcatcatttgttaggaagattatacccaaaatttacatctgtaacaaccaaaacgtacaagcataaacagcaacatagacaatcagcacacatacaaaggagaaaaccgatggcaagaaaaaacctgaaagaagcccgcaagagggcgggcatgacgcaacagcagatggctgaccggctggagataggattgcggcattataaatatattgaatccggtgaggtggtcggaaatattcagatatgggacgaactggaagatatcactggaatacatcaacggaaactccgagagatttcagaaactcatcccggcaaagaagataatcaacagaaacattaagaatatcagcaattcttacaagcatatcaagagacggtgaagaatgttcgctttcataatttctatacgtacgaattgatatagaaagttgatcagccattctttgagcagtaaaacctcttgatttacgaattttatttaagcgttttccaaacatagtatacctcctcaaattagtgaaagaaatctgcaccataatacttgacagtgtaataattttacactataattggggtataaaacagtgaaagaatcttgcactataaaggaggaaccaacatgaaaatcaaaatcacagggaacagatgtataggctgttacaaatacagccagtactacacgattagtgggaggggcgaattggaagccattgattgtgggtattgtggaatcaggcagtgtacaacaagaccgggtaaccgttgtaaggagtaccgagaaaaaagcaacgtgggattgagtgaagagcagctattaaggctacagtggcaaaaagagaagtagtacaggcgcaatcagcaacttagacaaccagtatctcatatacattaacaggaggtggcgtgtatatggcaaaaaatgaaaaggagtatacctgcacagtagaatacactgaaggctgtgaacagcggctaaccgaggcgctggtaggcatatattaccggcggaaaagagacaaggaacttgaaaatgtgactgatgataaaaccgcttaggcggtagaacggaggacaagcttagatggcaagagataacctgaaagaagcccgcaagaaggcgggcatgacgcagcagcagatggctgaatatctaggtatcagtgagactgcttatcaaaatatagaatatggcatttgtataggaaaaataaagcattgggataaacttgaagacctattcggagtacatcaaagagtattaagagaaattaattctcatgccgacaagtaagatcatccaatgtaacatcaaataggtttgcaagaatgattagtttttcaatattaggttcgtttttgccttgttcgtagtattgataagcacttacggaaatattaagcctgtcggcaatatctttctgagtcaaaggtgattgttttcgaagttctttaaggcgttcattaaatttcataattcctccatctgatattgacaccaaggtaaagttggtataatatacagatataccaagtaaaagttggtgttttaatatttttaatgtctaatactttattttaacatgtaatgagtttttaggcaaaggaggaagccatatgaaaattgaagtcacaggatcaagatgtattagctgttataagtacagccaatattaccatcggaattatttaggggaatttgaagcgattgactgtgggtattgcggaatcaggcagtgtacaacaaggcccggaaatcgatgcaaggcctataaagagagaagcaacgtggggattttaaggtagggggacaagcctatgtcaaaaagaatttcagataaggattttgaacgtaaatcaaagcagactgtcgatctcgtaaaagaattctcttgtgaatggtacggttttggagaaatcctcgaaaatgtaataagaggcatgtccgcaaacgccggaacagagtacgaggttgaatacacagagatacagatcaaacagatgttggagttagcaaggaggatatataaagatgagacggaagcaacgtgaacgcccgatgacggatcggcagctggtgagagttctggcggggctggtagttgtatggggagccatggttgggatctacatagccatggcataaaaaagtgcatatcaatgggcgggaacccgatatgcactccaataattaaatatcatttatattatagcaaattcaggaggaattgcaagaatgaaacagccaaaaaagttgagccgtattcagaaaatgttgttaagtcgaaaaggcttggatccagacgaatggcggttgatacatgaatctaaaacagatctgcagttgatccacaagctgacagatgaaataaaaacaattcaaaagtaggagggcataaggttggcgactgtaaaaattaagaggttaactctgacagattttaagggggtaaggaacggtgagtacgttttttccaataatactaaaatttctgcggcaaatggtctggggaagactacgattgccactgcatggtactggctggtagctgataaagattatgaattaaaaagtaatccgaatgttcggccaaatgggatggaagagtgtatccctcgggtagatgcagctcttgacattgacgggaaggaaatcacaataaccaaacaacagaaaacacttaagagcaaaccagacagtaaggggatcgtaaaaataacttcttccaatatctatgaaattaacagtgtcccaaaaacagaaggggatttccgtaaatacttggaagacgaaggaattaattgggagttgtttctggcgttaagccatccgaatgtatttactggtcagaaagcaacggatatgagaaagattctcttcaaaatggcaagtgaaaaatcagatctggatattgctaatatgaaatcagatactattgatattgctgccttgctttcacagggatataagctggaagaaattgaagcaatgcataaagcatccaaaaagaaagcagaggctcaggttcgcgatataccaaaccagattattggaatggaaaagagtaaggttgattatgattcagccgaactggaattacaaaaatctggtattgaagaactgatcgcggaaaaagaaaatatgttgtcggatgctgagagtacattaagcaaacatcaggaactgacggacaaaattatggaattgaagtttcagatgaattccatccagcaacaggcccaggacaagctaaatgctgaaagacgctcaattcaaaataaaattgatattgcagaaaaggattttcatacagcagtacagcggcataatatgatcgaattggatataaagcggttgggagattacataaaacgaatggatcaagagcgggccgaacttggaaaagagtataacagaaatgttaataagaaatttgatgactcagaatggactttcccaaaggattctacgctctgtccgacttgtggcagggcctatgattcaaaaaagatagaatcgctgagatctgaattcgaagcaagaaagaataaggccgcggaagattttgataaacggagacaggatactttaaatgaattgatttctcgtggtaatgaattgaagcgcgagtctgcagaaaaggcaaaggagctcgaagctaaaaaagctgaattggaacagatcaaagcagataaaatcaggttcaacaaggaacagactgaggaaacaaaaaaactctcagaacttccagaacgtattgatttgtcaggcaatcaggagtatgaaatgcttgaaaatcaggctgccagactagaagagatattgtcatcaatgaatgacggcgctacataccacagttctttaaaaaatgaactggattcttttagacgcgatttatctgaagtagaaaaacagattgccgttgccggcaggaatattgagattgatgaacagatagcagatttgcagaagaagcagcgggagtacgaacaggcgaaagctgattctgaaaagatactcgatcaacttgatacgctttcaaagcgtaagaatgaactccttgtggatgaaatcaaccagcatttcgggattgtgaagtggaagctgtttgattataggaaaaattctaaatatgtggagtgctgtgttccgatgatttatgacgagaaaagcggtatatataaagaattttggaacagcatgaacactggcagacaaatacaggcacagttagatatttgtaattccatgcagaagtttttcaacatgaattgtcctgtattacttgatggagcagaggcgattaataacatatatcttcctaaaatggattgtcagcttattacactggctgtatcagaagatgaagaattgaggtttgtatatggggaagttgattgatattactggaaagagttatggattgctgaaagtagattcttttgcagaaatgcgaaggaatgaaaaagggcatacaacttcttggtggaattgtacctgcaggtgtgggaaaaaggtaattgttgcgaaacactcattaacatctggaaacgtacagtcgtgtggttgtctgaaagcaaaaaataacatggagagatttacaagacatggcctaagcaaaacaaggctgtataaaatctatagcatgatgaaagaccgttgctgtaattctaatagtacagcttatgattattacggtggtagaggtatttcagtctgcgaagagtggcaaggcgagcatggttttgagcatttttacgcatgggctgtacagaacggatattcagatgatttaactattgatagaagaaattctaacggaaattatgagccgacaaattgtcgttggattccgtttgtagagcaggctaagaacaagcgaaattgccatttgatttactacaatggggaaataaaaactctttcggaatggagcagagaattgcaaattgccagaagcactatcagaaagcatgaaaagatgtttaatggagatggtgagttggcaataaagacaatacttacagagtctaacaatactagaaaaattaaggaagttaggaggatcagaatgaattacattaaagcgaaatttttaataggcgataacccatccggcagggcgtatacataccgctgtgcagaggaattgaaagccggcgaaatggttatagatgccaaaggaagtaagttgattgttgttgatgagccggtatggatagaaacctactgtgcggacaaggtggcggttgtgaagaagtatattgatccggttgcggaagaaagtgaggagtaggaatggcagagaaaaatgaagtggctaagcagccaaaacagcaaaagcatggtgcagtagttccgttatcattttatgcaaataaatttacaaaccttgttcaaagcgatttttcagagcatgggattgaacttgatgattattcaaaacagtgtgtaatgtcttccatgagtgcaatttacaatttggtaacaagcaataaggaagctatggaaaaccttaatccatctaacttaaggcaggtagttggacaggtagcaagcctaaaactcaatgctaatgctgtcccaagggagtgttacttccagttacgtagcaagcagggagcagatggaaaatggcacaaagaagtagaacttggaattgagggagatggtaacgatgccattcttcgccagtttggtgtgaatgtggcgaaagtgcatcaggtatggctggtaaaagagggagacatttttacttatccaaaacacaaaggaatggaactgaccccgccggaatgggaagaaaaaggggagtcacagaaggtgattcgagtggtttatccagttgaaatgatgaatggtcatgttgaatatttaattgcggagcgagagagtgttaaagcgaatctgttagctcatgttcgcaacagtatgatgaacgaaacatttggaatctgtaaggacagacacaaagctactgatacgcagaaagcggaaattaaggcgaagaagagtgaaatccttgacaccttaagagaatgccatacgattgaggacatgctttcttgcgaaacggcaaagccttttatcagtgcggcatggcttgacacgccggaagctatgattatccgtaaaatgcgaaataacgctattaagaagtatccgaaggacttcaattctattgcatcgcaatcgttgcttcagatggacgatacatataaacaggtgcaagaggaaattgctgaaaatgctaacagtgaggactttacaataaacgaatcggagatagctgaaacaattgaaaatccgaaggtagtagcagcggcgcaggataatggcgacaatccgtttgaggcttagactatgaaaaatattaaattgttatatgaagaattagagaacctaaaagacttccagattatcctaaaagaatttgacggtggtatgggtgtatttaccaaaggaaatcttaaagatatgaccgttatttggagctatggtggtgggtgggaacacgtcagtattgatggaaagaaacgtatgccgtcatgggatgagatgtgtcagcttaaagatatgtttttttcagatgacgaatgttgcgtacagtaccatccgccaaaaatcgaatatgtaaacaacattcaatattgtctgcatatctggaaaccaattgagaagtattccggtgtgttaccggttccgccgagcttatttattggagtgaagggtgtggtgtttgatgaaacttaaagtactcggctctggatcttccgggatgttatatcaacactaataattaactctggaatgatatttaaagattggaagtgatttattgcaggaagaatggaaatgggttagcgagtatgaagggatatatgaaatatcaaacaaagggcgattgcgtagctatagaagagacaaagttaatggttatttgctatctaatagaaattcaaaagggtggtatctaacagttaatcttttcaaaaatggaacgaagagaacaaaacgaattcatgttttagtggcagaatcatttatcggtaaaataccacctgggtatcatgtgcatcatattgatgataataagcaaaataatgtggttacaaatcttgagataattcatccaagaaaacatagaaaagaaaccgaaaaaatccacccacaaatcataactgggatgagcaattataacaaatttaaaaggccaaaacatattttacaatatgatacagaaggccattttattgccgagtacgctaacggtgaaattgccagtaggttaactggggtatgtcaaagaaatatattgcaggttgcaaatggtgaagaatataagccgggaaagatacggaaacaagctggtggatttgtttggaaattaaaagagggaagcgaggtggtttaatgctcttgaaaacgatagcaaccggatctaggggaaattcatatgctttaattggaaaaaatgaaattttgttgattgaagctggagtaagacttttggaagttaaaaaaaatattgattttcaaatctccaaagtagttggctgtttaatttctcatgagcatggttaggcgatcactcaaagtatttggcagaatatgaacgagctgggattccagtgtttaagccttataaatcggaaatggaactgcaggtgcgtacatatggaggctttgtagttaaatcttttccgctggtacatgatatagcatgctatggattttatactgtagagccgtcaatggggagccttatatatgccagtgatacagagtatataaaatggcggttcaaaaatgcaaatcatattctggtagaagcaaattatgcgaaagagttgttatgtgatgtggacactgagtcggcaaaacgcgaccatgtactcactggacatatggaaatcgaaacaacttgtgaatttttgaaagcaaacaacaatccgaccttgaggaacgtcgtgttgtgtcatttaagcagaagtaacgctgatgctgaacaatttaaagctaaggcgcaaaaggtcgttaattgcccggtttatgtggcggatgaaggccttgaggtagacttggattttccgttttaagagaaagatgacggaattgaaatcataggtaaaaaacaacttgaccggtcagtttttatatatgttatttaatcaatttatttagagaaaggattttattatgacaaaagtaaatttagaagaatttgcaggcggtgctttgcaggaaaagttcgacagagcgttcgaacaggtgacggagaatatgcttgatgtgaatactccatacaagaataagcgtgtgattacaattaaagtagcactcactcaaaatgagttaagagatgattcggtagcagaggtttccgttgagacaaagctcgctccggcatctccgattaagacacaatttgcattgcagcgcgatttggaaaccgggaaagtatttgcgtccgaatatggtccgggaattaaaggacagatgaccattgaagatttggcgaaaaaagaggaaatgattgatggcaaagtggttgacacagaaactggtgaaattaaagagaacaaagtagtcgatttaagaactgcaaaacaggcataaggaggattctataatgatggaaagcggattaaaagaactggtacagtatggaaatgaattggcggagccaaatttggttgaacgtatggcagtcacttattcagataagaaattatatccggtggatgaaatgcgccgggcagaagcattagagatgagtacgttaacaagccttgtagagtatatcaaatccaatacggataaatctacggataagatgattgtgcaggttatatcaccatgtgaggtgcggttggtatccgccctggacgatgatcgaaaacgtgagattttagttgatgttaatgctcaaatccctaattttgattttgggaagtatatggggcatgagagttttattattgctcttcagtcgaaatttattccaaacggtgatagtgaactgcttcttaaattcgctggaactgttgaaaatggaactgtagcacagtatggggatgatggagtaacacagaaagctacaattaaaactggcatagcatctaagggcgaggcggttgtacctaatccagtgaaattaaggccattccgaacatttatcgaagtggagcagcctgaaagtgcatttgtgttccggatgcgtcaggacgagataagcggtgtaggatgcgcaattttcgaagccgatggaggcgcatggaagaatgtagctatgaaagcaattaaagaatatttgcagcaagaactttctgaatacccggcgtttacggttatatcataataaatattccggcagtcaatcattgactgccggagattggagcgaagacatgaataaaacaattttagtgggtaggttgacaagagatccagaagttaggtattcacagggggataattcaactgcagttgcgagatatacattagctgttgaacgcagattcaagagggacaacgaacctacagcagattttatcccatgtgtagcatttgggcgtacagctgagtttgccgaaaagtattttcgccaggggatgcgcgtagctgtttccggacgcattcagactggcagctacacgaacaaagatggtgtgaaagtttatacaactgaagtcatgattgaggaacatgaatttgcgcaaagcaaatctgaaaaccagcaaaatcagagtcagaatacgggaccagcgccggaaggttcaggagacggatttatgaatatccctgacggaatcaatgaacagcttccgtttgactaagggcggtggttaactttgggagacagaaaaccatctgagattattcaggacttcattgatttattgaattatgctaatgatatttataatgaatccaaaagcgaatgtgaacgacttgactcaatcgagcgagtccggagttggcagcacaagttcgaatttgcaaaggacaagcaagaaagaaataggctcgcaactgctcttcacaaggaaaggcttcagaggagaaagttcaaagataccgtggacttatacatacatgtgcacaatttctcgaattctgaaaacaacaaagcagttctcaaacggcttggaggtatgctgaatttgcaaaagcggacagaagagtatttggacagcgacagagaatataaggcaggtgatgacgatgatagtgatagaggataaaggacagcaggataaaaaacatgaacttaaacatatttattttgaatcccatggcatttactgggaacgatatcctctcccctgtggtgattatattctctgtaccgataaggtaatagatgtaattaaaagaaaacaaaaacggggaatggaaccaaagaaaatggattttctgggaacatattccatttgcgtagataccaaaaaagatatccaggaaattatcggtaatatttgcggaaaggagcatgcaagattccgtgatgaatgcattttggctaagaataatgacatccgtctgttagtccttattgagaacgaagatggcatcaaatccatagatgatctgcaaacttgggataatcctcggctacatatgaaaaagtggattacaacaccatctggtgagcgaaaaagggcattgaaatatccgactgcaacaaaaggcgcttcattggctaaggcaatgagaacgatgcaaaaaaaatatggagtggagtttcttttctgccgaccggaagaatccgggaaactaatcatcgacttattaaatatgaatacggaggaataacatggcagggagacctaagaagcggattgattacgccggatggtctgttgacattttctccaatgacacaaagatagataagcttttagatgctcaaggatgggttggatttggaatttacttttacctatgccagatggcgtttggaagcgaaggatactactacgaatggtgctacgacttatgtgcaacgactgcaaggaagatgggcgggggcgttggtgccggtacagtaaaagaaactgtggactactgcttacagattggtctttttgataagaggctgtttgatgggtggggagtgcttaccagtaaaggtatccaaaaaagttttctgttggtccttaagagcaaaaatcgtaagggaacggaaatatatagtgaactgtggttgcttgataaaaatggaaaagattatcaagatgtagtttttgtacgaaaaaataagcagaaacttgaagtaaatgacgattcactaggagagaatgacaatacgcttgaagtaaatgacgattcactaggacaaaaggatagtaaagtaaaggataataaagtaaatacagtatctaaagatactgttcgtcagactgacgtccgacggtgtgtagacgcttggaataatttaaaatctttcggaatcaaaccagtatcaaaattgacatccggtacaaagagatatgacagcttaatcgcaagaataaaacagtatggtatcgatgatgtattaaaagcaattgataaaatcaaatatagcagtttccttcagggacggagtagtaaccggcgtcaatggactattacttttgattggtttgtgcttccgaataattttcccaaagtgctggatggtaattatgacgatgcgaatatcgtggatccaatacttaaaaataccaatactggaggaggtaggcaaggatgctaaacgaaaaagaggtgcgaaaagcaattgcacttatgaagcctgacaatcagttattcgaggtcagggtaatatatggcaataaacagttgtatagcggatattttcagaatgcagaggcattggtacgtggttttgacaaacttagaaattttggagactgcaatatctacatcacgcttaacacgctgaatgatgcgtgttatgacagaactcaacgagatagatttgagaaaaacccaaaagcaacgaccagtgacaatgatgtaaccggatacgactggatgatgcttgaccttgacccaatcaggccaacaggaacatcttctacagatgaacagatcaaaaaggcaaaggcgaaaggaaatcagatctataagttcttgaaaaaccttggttttaatgatcctttgtttggatttagtggaaacggtgtgcatttactgtacagggtatatcttgacaagtctgaagaagttacagcgttgatgaagaagtctttgaaaacattagatatgctgttcacggacgctgagataggcgtagacatgaaaaacttcaatccggcgagagtttgtaagctgtatggcacattggcacagaaaggggcaaatacggacgtgagaccgcatcgtatgagttatatcatcggtagcccagagaacattgaggtaaatgacatcaaatatttgcagaaattgtgcaatctgtacccaaaggaagagaagccgcagcggtataacaactaccagccgcgggaatttggtctggaagaatggatgagtaagtacggacttcgatatcgtaagagtaattattccgatggagtgaagtatattttggattgctgcccgttcgacagtaaccacaagggtaaggatgcgtgtatcttccagtcgcgctccggtgcaatcgggttccattgcttccacaattcttgcgtagataagacgtggaaggatgttcgtatgttatacgaaccagatgcttatgaaaagcggcagcgcgagtatgaacagagaatataccagaaaccgaatcggtttcaggaaataaagaaaattaagattgtggaaggcagaccgatattttacacggcgaaggacattctggatctgccagtccctgatgaaacatttataaaaacagggattactgatattgataaaaagatgcgtggattgaaaaaaggctatgtatctgtaatctcgggattgcgcgcatctgggaaaagttctgttatttctgaaatatgtttggattgtgttgaaacaagaaataatgcgggcgtattctcgggagaactatcaccgaaaaactttatgcgatggatgaacctgcaggcggcaggaaagggatatgtcgaaccaacgcggtttgacggatattacaatgtgcggaagcagtatcaggctgaaatagctgaatggcttggaaatcatttttttctttataacaacgagtacggaaataattttccggagatcatggaacaatttgagaaaaagattgatactgacaaactggatctgttaatacttgacaacttgatggcatttaatatttcaagtctaggtgataacaagtgggatgcgcaaacagaattcgttttaagcctcgagcgagtggcaaagcaaaaaaatgtacatattgctttcgtagcacacccacgaaaagcaatgggtttcctgcggttggatgatatatctggtactggggacttaggtaatgctgtggataatgctttcattgttcatcgagtgaataatgactttgtacggctaacaaagcagatgtttggttggaaagacgataatgaactgtacagagcaaccaatgtaattgaaattgccaaagaccgtgatggtgggattcaggattattttatccctctgttttacgagaaggagtcaaagcggcttaagaactatgtggctgaaaataagttgtacggatggaataaacacgatgatggatttgttcccgtggcagaagatatggaattagtattcgaataggagataagcaatggaaggaaaagtggatattcagaagctacacaacttaataaaggatatacagaataaaaactggaaagcgtacacgaatttcgtaaaatcaggaaacatggcgaaatataatcaggaaatggatgagatagtgtctgagatatgtaatttcacagacaaggatgttgctatagttgctaaagaggcaaatgatttttttatttgcggatggtcaattgttgtaagaaagatgcttatatcaatgcgaaaagaaggtggtcagaattagctgggcagataaagaaatcaagaaacataagattcacaatttagttgaacaagccttgaaggaccctcgttttaaagaagcacaaaagaagcaagcggatgaagacatcaaaagggcttttgatagctttcttttaataagtgtggattatctatatagggagtgtgattataacaaagatcagattttagcctatatggagtttataataaggcaacttaaattcgtggagacagatgaagattattttttattacttaacgaagcactgctggatgatatcgggattgatattctgaatagttcatttaagaaagagagtgtagataagagtgtgtaaaaagcaaagtgtgtatactccatattacgcaaagattcaggacttactttttcaggggatgcctattaaagaagtttggcaatatatgcgaatatattttggtatatacacagatctaaacacatttcggcattacataaaagtaagtggattaatttggtttgtacctatgtagacctgttaatttaggagaaaggagaaaagaggtgcgcgcataatacccgggttctcctgactagtaatgacagaagaaataaataaattaattgaagataatttaatgtttgcatattccatggcgaataagtttagaggtgtccctattgagtatgatgaccttcttggtatcgcaaatgtaggattagtaaaagcagcgcaaaaatttgataatggatctggtttcagttttacaacttatgcaggaaaagtgatcagcaatgagattcttcaatttctgcgtaaacagaaaaagcatctgtatgttttgtctctggaggatcccatacaagatacggaaaatattactttagaggacacgattgcggataaaaaggatgggtttgcggaagtagaggctattatggtcattcaaagtagcattgattacctaaatgatagagagttttctgctgttgcgcttagcatagatttcccaggagttagtcaaacacagagagcgaaaaagttaggggttagccaatcaatatattctaggtatttgagtagtgctaaacgtaaagtacgagcttgtttttaataacaatttacgggtgccgggcatccggcgaagtgcagcggggttcgagtccccaaactggagggttcgactcccggcagtgcatggtgcaaaactccgcacaactattttaacatttaggaggtacataatgatacaccagttaaaaatagaaagtgaatattttaagaaaattgtagaaggagtcaagagttttgaagtccgtaagaacgacagaaattttcatataggtgattatctgggcttaaatgaaattacggaccattcctgcaatcaagagggagaacgggtagaaactggaaattttgttttagctaaggttctgtatgttttttcggaagaaaagtatttgaaggaagggtatgtaattttgaatatacgcccttgcacgataaaagaagttgattgggactatgcaccgtggtattcggaatgtagtgcggatacacctattttaccaatataaaattaaaatttaaaggagtatgcggatgaatagaacatgtatgtattgtgaacatcattatccggtaagcgacagcattgatagcatacatatgatctgcatcaatgcagaaagcgaaaaattattgcaggagacagacttttttgatgattgcaaacactgggaagaggaagatatagaagattaacatttagatcaggaggtaaagaatgaagtataaatgtgtaaattcttttacggttgatcattacgatgaaactggaatggcaacggaagatcgtatagaaatcagtcgtggaagtatctgggagcgcgacaatgagacggatattataggagcgggagtgcatcttgataacctggaaacaatggagtggttagaaatatcagaaaatgacttgaaagaatattttgagttattaacttaataaaggagaatagaaagatgaaaaagaatgaaattatgttagttggagtagatattcacaagtttgtagaagagttatgcaatcggtttttgagcgaaagtcatgatatgacagacggagaaaagaaagcatacaatcttggaatagaaaacacacttggattattaaagcaaacgacagaggagttgtttgataatggaatagttgactacgatcagtatttagtacatgttccgggacttgaggttataacggaatttggcagcataaaggatatacagaataaaagtaaagcggattaaaattagcatttaggagaaatggaaaataaaaaatataaggtcataaaacaatttgacgcattttattgtgatgtcgggagaataacagtaaacccgggagcactgtttaaaataaccagcggcagagtttactttttaaacacccaaaattatttgccgtgggtagcgacaaaattatttttatcaacgactgataactatatggagaattaacatttaggaggagcaggatgaaaaatacggaaaggatcagagcaatgacggatgaggagctggcccattttttggcaacggtagaggcgaaattgtatcgtgatgatttggacattattgcctatcgtgctgacgaggtggcggatgccttaaagtggcttgaaagagaatcgttttaacattaggaggataaggatgagattatttagaagtattgatgagaaactggaatcaattggttttgtaaaagtatcagaagatgattatggtgctaattttgaaagaattaatgacaaatataattatacgcaatgtgttgatttattacataaagcatcaggagcgcatattatacagtcctacgataaagaattgatggatgaaaagaaaatcggtaatacttgcgtggggcttacatattacgaaatgaagttatttatgaataaaatgagaaaaattggattggtaagtaagtttccattgacacattaaactgacatttagctgagaaggagaagagagatggcatatgtaagatgtggaaattatgattgcgaatatcacaataaaggaagagggtgtgctctaaaacgtgttggaatatcgcgtcacgataaggaagagatcccgggaggagaagagggagctacactggataatccaacatattgtatatcctataaacagatatcatctgtcggcagacaggcgaaaggagattagatggaaagattaacaaccaaagggtataaatataatagcttagacttcatggatgatggtatacactattttgcaaataaattaagcaggtatgaggataccggcctgactccagaagagatcatggatgttaagtcgctgaccggttggatcccggtatcggagcggctgccggagcctgaaacagatgtgcttgtacaatgggaaaagtacgatagattttcaggggatacttttgtttattttgaccatatgtggcgtatatgcaatgaagatggagaagctgtatttgaatctcctgccggtatacctagcggaagagtagtggcatggatgccgttaccagaaccgtatagatcagatagtccggctacagaatggggaaagaaggagattatgaaatacaggaagaaaccagtagtaattgaggcgatagagtggaatggtgatgttgaagctgtaatggagtttatgggagagcatccggcgtttgacaatccagaagttttctacaacgaaggtagcatgtgtagcataatgatccaaacacttgagggtacgatggaatgcgcaccatatgactatatcattaagggaatcaacggagagttttatccatgtaagccagatatatttgaaaagacttatgaactggtagaagactaaaccagagtagcatccggcggcgggccggggaaagaggtagaagatgaaagagaaagttaaaaagtggggaaaagaatttgaaaaggcacttatacagttgcttgcgtgggcgagcataggaatatttattggaatgggtatagcagttggattttttgctacaagcgttatattgctgcactaaacctaaatttaacatattctgcttctgtgggattaatggagcgtgtgaagaaaagtctgtaaatgctgatcttctatgataacaggtgggctgaaagttcttagttgggctttcagcccttggtttatatataacagcacatgctgttgcatgtcaagagcaggcggaaaaatccgcctgtagcagattgcttaaaaggacttattctggtagccgcctccggaatcgaaccggaggaactccaacgacttaattttaaggttgccaatacaattctttccgtcttaatgtctgctaattttcgtctactggtccaatgacatttaaggtaacattttcaaccggattccccccaattaaatgtggctttccatactcggaattacatccgatgcatacatcataaccaatattgcagtttttcttaaaaatcattggttgtcctgtgatgcactcaccaacataaaatccttctggaagttctactatatatgggtctgagtatacgtgatcccagtcattccacacttcttcgagactccagaaccatccgccgaaaagatttggattataccccttatatagagtaattgtgttttggattttattatttttcataatgtccttctttctcccggtgtcctccgggtgctctgctgttttatttgttaatataaatatacacgataatagacggtaattcaatgtgcaatagtacacaaaaatagatgtattaaaataccattttattatgaaaatagtacaagaaaatagacgttgacgaaatgaaaaaaatctattattatatacataggaaagtaggtgttttaattggctaattacggggaaaacggatatatagattttgcgaaattgtggattgttatgaagaaaaaagaacttaataaacagtggcttaagaataatggcctgcattcaaatactgtcgcaaagctgactaaaaatgaaaatgtaacgtgtgaggttatatgtaatttgtgcaggttgctgaattgtcaaccgggcgacatcatggaatataaaaataagtaaaatacatgttaatagactattgacatatacacgataatagactataattatattaacaggtaaggcaagtgcctgaaaaaaatggaggtggcgcaatgttagatcagaaagacttagaagcaattgcaaaattgattgatgcacgggcggaacagactgaaaacctattgctagatgaaattggaagaacccagacatatctcgagaagcagatcacggaagtcaagaaaaatatggaagagttaagtcagtactaccgtatcacaaaactcgaaagtgataatacaactctattgctcaagatgattgatcagctcaatagaagagttgaggagctggagaagagaacagcataacaccataaacttggggccggacttgccaccggctctataatataaaatcaaggggttgacaagccccatgatctaatggtatcgtaatagataatatagtagtcctcttgtgaggtggattgaaatcttggtagctctaggagccgtgacccgttgcataacgtaattgcagcaggtggcggctttttttatttgattttggagggtttgagaatgagctgtaaattttggagatgcttaaaattggacgatgataggatatgcgaggatctggattcagagtgtattggtgatctatgtaatgagtataagcaatgcagtacatgtaataagcaggatattgatgactgtccacagtattaagataatcagatcagcaaaggcggtgcagtaaatggtagataatacaatcaaggatcatgatggtaatacaactgatgtgtatgcagattatatacagctctatgtacaggagtatataaatacagtcctaaatgatatagacgacataaaacgtaaacagtgttttgctggtatgattaagtatgtcgctaaaaagattgcacctatggttaatactgatgatctggttatgttagataatctttgggatatatatactggattatgttacagatataatcatgtaatcactatagagcgttattgtatattaataggcattgctagagatacgttttatagttggtataagggtgagtaccgtaacgattactgccccgaactcggggccacacgctccgacgtagtaaaaaaatgggatcgcgaatcagagagcagttggcaggacgaggccacaacgggcaaccctgggccgatgtttgttctcaaggcccggagaggatggagtgagcaggccccggcaatcggacaaagcgaaaatcgcatgctccagaggacggcggatcaaattttatctgactaccaggagcccaaacagctcccagataaggatttttgagatacaattttaaaacaattcaaagcaattgtcagataatacgaggggtgaatctatatgttgtatgcaagcaattgataacacaatatgtagcatgctatctgtataacaaatagttatttgtcgtatagatcaaaaatcttttgatgcgttttagggactacggttaatgggggtgggggtctggtggaaacgccccccggggcacctgctcggtcccccaagcaaattttaaataaaaaaggagtcttgtcatgataataaaacttcacagacataggttttcctttggcttacagattaaccgtagaatatatctgttacagttttctacaaaggaaccttggttgattcctaagagagataaacactatggagaaaataatgatattgttttgtatggctggatgtttgtatatttcggttatacgaacttgatgagagaataataagtcgtaggatgcagcagaaagggtgagaaaatgaatagagtgcagattaaaaattcaggtgatggttggctcggaacagaatattggattgacgggaagaaagttccaagggttcgttcagttgatttccatgttgcagttgatgaagtgccagtgtttacttttgagacaattggaagaccggatattaatatgccggggcaagtagcgtttgaattttcgccggaagatttatcagatgcatgcttcattatttccgaggaactgaaaaagcatggtggtttctacgatgggtttgtggagaatgttcgttcggttttgaaagaacaaattgattggataacagatgatttaatggacaagaaagcggaagaaatcgtaaaactggtattaggtgcggaataatgacaaagaaattactttgacagatattagggggatgtatgttaagaatagtaatcatagcgtttaatataattatggccttagttacgtgtgggagtgtcgttcgtgaagatgattttagtaataaagtgttttttgttggattaactttgcttttcatagaaaattgcattttgatttggagataaatttatgaggtaattatggttattacatatttcggaattattctgttcgaattttgtggatggattaaattcattaaaaagtcctgcaacgcaaggcacgaaaaatattactgctaaccgtcggatggcggttatgggaaagtagctcaactggcagagcagcggtgcgcaccataaaacagggagagcaagattttggttcgaatccaaacttttccaagatgccgggtcgcgcccggatgatgtgagagtaagcagaacacctcacggagaacgaaaaagcctgctgaaaactgcttgcaggaagttcaggcctatgccaatggtatgctcggaaacctttaatgttatatgcggtcgcggcatatgcgcaagtgtgaaaatttaagcgggaactgcatgatggcacatagcacaatgggagggcgcacggcttatatccgtgtaatcacagttcgattctgtgtgtgccgattttccagtgaagaggctggttacccatattggacggaatgacaatggcccgtgccttacgggtgtgagccgaatgaccggtatgattttaggtaataggtggatttgatgaaagaaaaagatgttgtaagaataggaagcaaatttaatagattgcttgtggtttccgagtacccaaaagataagtatagccataaaagatttttgtgccaatgcgactgcggaaatgaggttgtagtacttaagggccaattaacatctggtaagacagggagttgtggatgttatcagagagatagggcgagagaagcacaacttaaacatggaatggcaaatacaaagatttactatgtgtggaaagacattatacaacgatgttctaatgcaaattccaaatcttattccaattatgggcacagggggatttctgtttgtgacgattggcttggaacaaacggttttgaaaaattctatcaatgggcgttagataatggatacagagaagggcttgaaattgaccgtataaaaaataatggcaattatgagccttcaaattgtagatgggcgactaaaatacagcaagcgaacaataaaagaaataatattgtgataaaacataatgaaaaagaaatgacagtatcacaatgggcgagggaattgggaattgatgataaaaaaatacgtcaacgaatacagaagctaggttgggacaatgagaagtccattatggttccgtagggatgcgtgggaagctgcttatcctgaatatgaaatataatctaacatagaacattgataattgaatattggcggtttgagtggtataattataaatcataagagaaaagaggggcatatatgtggacaactcaaaatcctactcattgtccaaattgcatgagtagaaatattgtgcttggagacaaggtatataagaaagatgtatttggagaagatactgatatagttattttaggatcatggttttgcaatgactgcggaaatttaattgggcgcaaaatgaatcaatatgaaaatgatttagacaaagagagtttatgaatgccaaccgtcaatattcgatggttggcattttatttttttacgtaaaatgataaaaaggaggtgccgtaaatgaatccaatagagttttcagaacaaaatgcagtctttaccgcggaaggatgtgataaccttccagcatgcaaacagtataacgaacagtttcagacagatgaagtgatttcttgctgggaattttcggacgatgaaattgtacagattttgaaggaagtgaaaaccggcaaacgtccgcagattttcttatcagtggtgggcggtcagccgcgggtgtcattgtttatgaggaatgagagggaataattgtaaaatagagtgccactgagcgccattcaaaggatggtgcaatgtggcagtttcagacaaaaatagacaaataatcgaagcaataaaggattctgacctgactcaatacaatcatcttcgtgatctcttagatatggctatactggtatatcaggaagatgagacggatttggattactgtttgaagataacgaaatacataaaagagttaattccaaatcttccccccacacaggaactaaataatttatattggagagccattttatttgaggcacctaatatatttgaatcttttcttttgtacatggagcgtaacaggaagcctaagaagagattttactttccaagaaggcgaacactcaaaatcgtagtagatgatttacaggatttggaagatggtaaactagattttcttggaatcagtctcccgccacgagtaggcaaactaatttcagacgacacgcctgttttgacggatgaaggttggaagaatcatggagatttgaaggttggagattatgtgtatgactatgatggaatgccagtaaaagtaactcatgtatttcctaaatcatatgcaaataagcgagtctggttcaccgatggttcgtacatagattgtcatgaaaaccacgagtggattgtaagagatagacatcagcaaaaagaaagaatcatggaaactaacgagttgacagatatagcatccatagatgcaaatactggaaaaagaaggtttatgtatcagattccactatatcagccaattattggttggccaagaatacttccagtacaaccgtatacttttggtgcgtggcttggagatggaagaaatcaaaatccagatatatgtggtagttcggacgactacgccattgttgagtctattgtaaatgatggatatcctatttcgtggcatacaacacataagacaacaggagttgaatattacggttttgcgggattacgagatggtctgcaaaaaatgggaatgtgccatagcagaaaacgtgttgaaaaacgtattcctggaatttatttgtgttcttcaattcaacaaagattagagttgcttgcaggattgattgacacagatggatgcttaagaagaaaagaacatagatatgatttcactacagcagaagaaatgctcaaagaagatttcatatctcttgtatcaacatttggatggagatgctatgtcaaagaggttgaaccacatgtgtcttcatctggaataaaatgcaaaaaaaaatactgggtgatttcatttaatcccacacatccaataccatgtagactagaaagaaaacagctatttgagttttctcaaaagagaagaattgcaatcaaaaaaattgagaatattgaacctaagcagggaaattgcatatctgttcaaggcggaatttacagagtcggaagaaggggtatcccaacacataatagtacgttatgtattttcttcttggcatggattattggtcggcatccagaaagccataatgctatgtcaggccattcaggagtactggcagatagattttataatgatgtaattaaactcacgctaaatgaagagtatactttttcagaaatatttccgaacgtttcgctatgtgggaaatcagcagagaagaatgaattaagatatagtgagcttgaagcatttgcaacacttacttgtcgtggtattgatggtacatggaccggtgctgttgatatatcttctgatggatatttgtatgtggatgatatgattcgtgacagaactgagtcattaagtcctatcagattggagaaccggtatcaggattatttgaatgtactggttgaccgaaaaaatgatggagccaaagaattaatggtagggactcggtggaatgtgcttgatccgctcggaagagtagaaaaggataataaagacaatccacgttatagattcagaaaaatcccagcgttaaatgagcataatgaatccaactttcagtatgattttggattaggattctctaccagatattatctggatatgaaaaaccgacttgataaaaatgaatggatggcaaaatatatgcagaatccatttgtgagggaaggattgctattccctgaagatgagttgaattattataatggtgttcttcctgacggtgattgtattaccgctgcggcctgtgatgttgcgtggggtggtggcgatagtttatcaatgccgtttggaaaagtatttggaagtagagaagatggcccagtatatataccagattggatattcaataaaggcgataaatatattactaaaccattagtcatagccaaaacgatgcaacataaaccaaatatggagagattcgaagctaataatggtggggatgaatatgcggaagatattgaccgtttgcttcagctacaaggattcaaaacaaatattacatgggcgaaggcaagtaatcagttgggtaaaatggcaaaaatcattcagtacgccccggatattaagcgtagattctattttttgaagccagaattacagagtgaagagtataaaaaagcaatggaagaattatgcatgatagtgcaaattggcaggaatgagcatgaagatagtgctgatggattagtacagcttctgcaattaatatctggagaatcatatgcaaaatgtgaggcagtaaaaagaccatgttaatggaggcatgtatgataattacaagaaaagatgtcataaactatcatctattggaaccggcaattgaaaaaaataaaaagaaacttgagcggtataaagacagggaacctggtgtaacggcaggaaaggttaaaggttcttcccggggattcccgtatgtacaatgcaattttactgtttgtggagctgaatctgaagaatataagcgatgggaagaatgggatgttaagtgcagatatcttgaaataagcattaaacaggatattgagagaatgcaggaactgaaattagcaattgatgagttgatttctggaataacagacattgaggataagatgatctttgaatacaccgttgagggtaagagccagcagtggattgcaaataaaatcggaatggatcaatcaaatgtgtcattaaggataaaaaagtatttaaaatagcaaagtctcataaatttcataattatatatggtattattagaatgtaaaaagagtgttgaagataaaagttaataaaaatcccccataaagcattggctgataaaatttgccgatgcttttttgttgtatgaaagttggtgaaatagtggatataggtagcattatttatcataaaaatagaaaatcgtttgtagatgtctgccatggccggtttgggagaaaagtaatctataccaactcgaaaacgatttcaaaatccaatgttttagaaatattatctaaatcactttctatccataatcagaatagacgggagattgactatttatatcactatacaaacggagatcagcctatattgtatcgggccaaggatgtgcggccagatataaagaataatatagttgaaaaccatgctcttgaaatcatgcgatttatgacagctcaaatgtatggtgagcctattcagtacgtatcagttaataatgacgaagaaaaaacaaaggaaattgatgcgttaaacaatattatgaaagttcttgataaggccagtgacgatgttcttttaggagactggcagagtactgcaggaacagcgtatcgtgaagtttggtcgaaattaaggcgtgaagttgatccaggagaaccactgatgggtattgatgtatcagacccgcgttccaatttcattatctactcatcaacccatggacataggaaaatgatgtcggtttctatttgtgaagacgaaaaaggcgagtcttattatttatgcaccaccgataaccatgtatatgaaataaaaggtgaaaacgtagaagaaacaatcaacgggtatgggagagtacttcttacagaataccctaataatcataggcgattatcagatattgaaattgtcattaccatgcttgatggaataaacaagatccaatcaaaccgtatagatggtattgaacagttcgtacaggcgtttatgaaatttgttaattgtgagatagatgaagatacctttttaaaaatgtgtaaattaggtgcattgaaagtaaaaacggtaaatccgtcatttccagcagatgtcggtatgatatctgaacaactagatcagcagcagactcaaactgcgaaagatgacttgtataaaaatgcccttattattgaggggatgccaaacagagagcaaaatactggaggagacacagggcaggcggtatatttaagaaatgggtgggacttcgcagaacagagggccaaaatagatgaaccacttacaattaagtcagaaaaggacttcctgcgtaatgtattgctcatattgaaaagaaagcaacagatatcgaaagagttaactattgctgatatagatgtaaaaatcaccaggaataagacagataacatgctggtaaaagcacaggcacttctttatttgctcgaaaaaggaattcatcccaaaattgcaattaaaacatgtgatctttggggggatccggaaaaggtttatgtgcaatctaaagaatatttagatgtattgtacaagacagccgcagagaagcagatagaatatgaaaaggagaaacagtcaacattagaattggcaaaattaacaaaaggaggtgttgaaaacagtggaaataaggtgtaagaattgtggaaaactccttggtgattttgaaggtaaaggaactgtcaagtgtactcgtacagaatgcggtggaatgaatattttcgaaacatccactggaaaacatgaatttatacctaaaagaaagccaagttatttgaaaaatagggcgacatcaagtggagtaacattcaacagatgatgctcttttatttttgcaggcctgagcgtaagaaggcagaaactatgcggagcgtcccgcgttaaaaaagtgtatgtttcagaaagggagagatgaaaaaatgacacgtgaacaagtaaaagaacagtttccggatgcaactgaagaacagataacagccatattgaatataaatggcacggatttaacagcagcaaagaagaataatgttgatcctaaagaattaaaacggttgcaggaaagagatgttgcatatcaaaagttgcttgatgcagatttgacagatgcggaaaaaatccagaaagcattaaaagaggcagatgatactaaggctgaatatgctaaaaagacaaatcgtttagatgtggaaaaaatactgatttctgcggggcttgaagaggatgattattcggggctgattgacggaattgtctcagaagatgctgaaaagtcaaaatctatggcaacgtcactggcaaatatgcttaataagcagaaggaagcaactgagcaaaaggtaaaagaagaattaatggataagactaagacgcctggcggatctggaggttccggtgacgaaggagagaagacggatgctgaaatattcgcagaagcgatggtaaaagagagcgcatctggtgcaaagggagcggaagacattattggagcttataaataaggaggtaaagaggttatggcaattcaggctatgagtgttacagaaactaaaattgcagatgaagtgcagattctaaaaagaccgggattcgaagcaatcccaatcacgttggactctacagcgtttacagatggtgtctgcagggcaggagcaccgattggtgccggtggagttatcaaaaatgataaaaactgtatcggaatcctaaaagaggatgtccttcagagcagaccacagggaactattttaaagaaagcatacgtcagaaatgacgtaattacatcacactatggaacagcaattgctgatacagcaaaggcggcgcttccgatgatcgtgtttgaataaggaggtaaaaggacaatgattaagattaacgatgtttacgattcggctgcaattgctgtatatgtaaagaatgaaaaaagtaatgctattccttatcttggtacggcattttggccgaatgaaagaaaagcgtccattgatttgaaatggattaagacggcaaatggactgccagtatctcttgcgccgagcaactttgatgcgaaagctacgattcgtgcgaggaaaggattcaagttcacaaaagaggaaatggctttctttcgtgaaagtatggtaatttccgagcatgatcggattgaacttgcaaaattgaacgattgcacgtctccattcgtaaaggatgtggttgcaaatatctttaatgatactaggaatcttgttgatggtgcagatgttgttccagagcgcatgagaatgcagcttttattccctgagacaggcggaccgtctatttacatctcatctgatggagtcacatatcagtacaactatgatgtggatggaaactgggcgaaaaacaacaggaaaactttaacaggaccaaaactgtgggcaaatagaaagacagcacagccacttgaggatatacggcagattgtcgaaaatgcggaagagccgattaagtatctagtgatgtctcaggctgaacttaacctgtttatggcatgcgattcagtgaaagaggcattgcttgcgcagaatacaacggcgcatgtgatgatgacggccactgtagcgaaacaactgatttcaaatacgttccctgggattgaggttatagtatacaagaagaaatttaaggacgagtctggtgcgacaaaagcgtttgttcctgatggattcattgcatttgtaccagaggggaaacttggaaatacttgtttcggtatgactcctgaagagctcgcaaagatggaagcgcaggatgtggatgttacaattctcccatctggggttgcagtggttgttatgactacatacgattcaaccatgcagacaactactgttgtttcagagacactgcttccttcttacgaaagaatggattctgtgtatctgctgtctacgggaacaattgatgatggtggtataggcgaattagaggaactaactgtaacaagtgcggctggaacggattccggtgatacgaagattacggtatccccggcattagaaagcggacattcctataagtataaagtaggaacggatgtgaatgttccggaatacggtgcgtttgtgaagaactacactgcatgggatggtactgctgacattactgcggctaccggaaagaagatttgcgttatcgagtgtgattcggattatctggcagtgaaagcgggaaccgctacagtttcagcaaaagaataaagaaggtgattgaggatggagaaaaaattaattaatgaaataattacagatttgacagatgaattgtcgaaagataaagattttgatgaagatgctttatcctcaaaggtcaagaacgctgttcgagaaatccgtagggaccggaattatccggtatcctacggagaagatcagattatgaatgatttaaataattattattccaatatacgtgaacttgctttgtacgattataatcagattggtgcagaaggacagcttgctcattcagaaaatgggactagccggacatggaaaaaccgcatagattgtaaaaatggtgtggtagcgttttgcagatagctggtgttctaacaattccctttcctcaggtttgaacggtattgactaatcaatgaaagcattgatagaagattgtgcgtggagaagtccgcagggcgacactcattaggcggtggtgggcagagtgattaaggcatagatgcgatttggagggtatgagattatgcgttcattgaaaaaaaataagagtactctttactatgctttatataatgaaaagaaagaaatagttgacgaaaatggagattttaccggggaatacattgttggttatagtgccccggaattttttaatgctaatttatctgcagggaaaggctctgcacaggcagatatattcggagtaaatgttgattttaccagaacaatatcaacaacagatctgtcactacctataacggaaacatcgttagtctggtatgaaactaaacctaaaatattagaagatggcagggcagatcctgaaagtgcggattataaagttgcagctccgccggcggtaggtttgaatgaattgataattgcattaaaagcgagggcaaagaatgtctaagagattcaggactggtttgtctggtagcggattcagaaggatagccagagaaatccaccagtatagaaatgagctgacagataagtgtgaggagttcgcttatcgactggcagaagagggcgtggcaatcgcacaaattcatattggttcaagtgggtatggaaagcacatcactttggattctgaaatgaagattgaaggaattggttgcagagcaattatatttatggaagatgcacagaagatcatcagtcagtggcaaacacaagatggaataaagagcgcagaagtcagtcctacattaatgcttgagtttggcgcaggattaaaagcggagaatccaacaggaattccgggtgttggaactggtacatttccgggtggtacacatggaaatgagcctgggtggtattatatggacataaatggagaatggcatcattgcagcggaatctctgcaaatttgccaatgtacaagacaggtcaagaactacgagataaagtgattgatattgcaaaagatgtttttggtttatagagagtgagtcatgttcgggtatgttccgaacgctctccattaaaatttctttggcgtggcaaaatgctacgccttttgtaatggagaaaaatatatgaaaagaaataaattcggattgtcaagtaaggaatacgaaaagctgtacagtgtttggggcaatatgcttaaacgttgttacaatgaagaatgtgatcgtttctatgcttatggggcgagaggaatcaaggtgtgtgatgagtggagggatgattttcatttatttgcggattgggcattgaaaaatggatggaccccctttctcagcattgaaagaaagaatctggatcaaggatattcgccagataactgtgagtttataacgatgaaacagcaagccagaaataaggcaagcaatattagagttgtttatcgaggagaagacaagtgtatagccgaatggtgtgaaatactcggacttaacgataagcgaacatacaggaggtatcagcttggaattagagaaccggaagtcttattttatcccggagacttaagaggcatgagggggcgtagcagaagtgattgatgtatcaaacagagttcttacgaatgtgaaaacgtatatatccgatatctgtcagaatgttcagagtgatagcacgaggactcctccatcatttccgtcagcttcagttgttcagattgacaatccagacacggcagttgacttggaaaatactgaaaatgcggtgttttccactattgaaattcagtcgttctctaacaagaacattacagaagctaagacaatcatcaatagtgcctgtgatgctatgagaatcatgggttatgagcggcgatacggtccatcaaaagtagcgaacgccgcagacactaatatctaccgcatggtggcaagattcaaaagaattgtgtcgtctgtggaggatatagataaatttgataattaaatgatttcgagcgccattgagcgcctttttttattggaggtagtgtaaatggcaggtggaagaagtaccattaatacagtattaaaatgtggtgatgcaaaagaaagtcttgcgaagttatgtaaaatcaagacatatccacagttaggtggagaaccggagcagcttgagacaactgatatggaagataccatgcagacatttgtgccgggtgttcagcaggtcgaatccatgcagtttacagcaaactatgaaaagaacacctatgaagcagtaaaagcggcagctgataaggaaaagttctatcagttagaatttggtgaggcaggtgttgatggaatattcagctggaaggggcagcatagcgtatttgtgaatgaaggtgaagtaaatggcgtacgtgagatgacgatcactattacaccatccactgttatttcacctaatgcagtagagtagaagattttaggagtgggataaccgctcctattttttgtgaagaggagagcacatagatggatattaaaataaataacaagaaatatagagtcccggaattagtatttgagcattttacgaagatggaagagcagggattctctgttacggaggcttttgaaaaaaaacagtacatgctgattgccatgggatttgtttgtgtaattacagggcttgacagggaagaagcagaagaattaattacgcagcatgtgtacggcgggggaaatttaattgatattgttaataccttctcggaggcagctggtgagtcggattttttccgaaagatgctgaatattcagcagacggaggaaacacggaaagtatcaatggaggaaaaggttccggcggaaaaagaaacaaagtaaaaagctacacggattgcatatatgaagtatggcttccagcagcaataagatatgggatcccatatgaagctttctggaggatgaacccaaaacgcttaaagccttttcaagacgattataaccaaaagatgcaggctgaggctgataaaatggattattcctgttggttaatggggcaatatatggtctgtgcaatccaaaaagcattagatccaaaaaaagcgaaatatccaaatcagccatttggaatgcggtcttttgatgaagatgaagatagcgatatttcggcaattagattcggtgaatttgtagatgcttttaataaagcatttgagaaaaagtagagtgccatgagcgccatgatgaaaggtggtggcgtaagtgggaaatgagatcgataggctggaaattgtcgttgaggctgaggccagtaaagcaaatcgtaatctggccaaaatggaaaaacgcataaccaatatcgcaaacgcgttggataaacttggtgcattatccggtgctttgggcaatgttggaaatgtagactttggagaatatgaaaaagcatctaaaaacatagatgaactacttggaaaatccaagaaatcccacaatacggatgctacacctaggattaataaagcagatattaaatatgcagctaagacggctgaagagcttcaaaagaaatttaaagatgttggaaaaaacattgacttctcagggatgaatagcactgaattgcggaagcagataaagtcgatggaatctgcgcttgatagaatgtatggtaaccaggagaaaagacaggctattgaaggtgagaaaattccgggtaagtcttgggtgagtcaacaatatgatattgccaaagtaagcaatcagttggagatagctcgagaagcattgaaaaaatataattccgaagcggcaaagatgtataaatttaccattgataggaaccaatctgtttcatcgatggaagaagtgccaaaagttgcgaagatatcccaagattctatgaattatgatccagaagctatgagaatggtgtttggtgaaggcgctgaaaaaattcgtaattttaacgatttgatgaaacaatttaagggaacagcgcagtcggcaggtaatgccatcaatgaatttgaaggctctatggattccgcaaaagttaatacatatgaggctcagataaagcgtctgaaacaggaacttgccgaattagctaataaaggcttttcacaatacgacccggaatatgattctgttgccaagaatcttcaagaagttatatatgcaaaaaaagcgtacgataaggaactaaagtcttctattcaagcagaaaatgaatctgcaaagtcaacaaataatacggcaaataccctgaaaaatctgaaaagcgtattaagtggtgcgtcaagacttttttcttcaatagcttcaggagctataaaagcgtataaaggtgttgttactttctgcagaggagccaaaaccataacaaaggcattggcttcacctattgcaactctaggaaaattgaaaaatgcattgcttggagtgcaaaagcagtcagggcgaaaatttggtgttcctcagatgataggaatgtcacttctatattccagcgtgtttggcatgatttctggtattaaacaggctatatcagatggaacaaagaatttagtgcaatatagtaatgagtataataaaagtatttcttctattgtgtcagcacttttgtatttgaaaaatgcatgggctgcggcgtttgcaccgattgttaatgtagtgggtccttatattcaatctttcattaatatgattgcctcggctttaaatgctgtaggtaagttcatggcagcattgactggaaaagggtttgttgttcaggccaaaaaggtgttccaggattatggtgcatctctggataaaacctccggtggtctcgatgatgcaaataaatcagccaaagagttgcagcggactattttgggatttgatgaattgaatgtattaaatgcacctaacaatgactcgggaaacagtggttctggcggaggagacggaattgagttaactccaagcgatatgttcgaaacagttccggttaccggtgcagtagctgattttgcgaaaagattaagagaagcgttcctgaaagaagattgggaaggtttgggcgatcttatagcagaaggacttaataaaggattgcggaagatttatgatgcgataaattggaacaatgttgggtctcaaattacaaaatttgcagatggtttcacacggacttttaatagagttatcgagaaccgcggcctgtgggatacgcttggaaggactataggaacaggcataaatactgctgtaaaaacagcaaatttatttattggggatggcggtatcaatttcaaagcaattggaaccggtatttcaacagggctacgtggcgccataaatgaaataccatggactgaacttggtaatcttttgggaaattggttcatggttccatggaagatattgaatggttttgttaccgatatgtccaggaaaaatgatttagggttgaccggatgggcagaactaggaaaaggactcggaagagccttaaaaggagtatttgagaagatagactttgatactatagccgatacgtttgtaaaagggtttaatggaatatttgaggtactgaagaactttaatgcagaaaaaccatttgaaggtttaggaaaaaagatttcagatggcttaaacaagattattagagggatagaccccggtgaggcaggtaaggcaattagcgattttgtaacgggtgttcttggagtactcgttgatgtagcagaacaaactgattgggaaatgttcggtaggaagttgggagagcttctgtcaaatattgattggaaaactattttaggacaagtatttacaattatttcagaggttttagggggacttatagaaggtctttctcagacaacgggaggcaaagttgcactttttatggcaggattagctgttgcatttaaaggggcatcagtactggcttccataggcgagtttgtcggtaaggtgaaaactggctatggagcattgggcagtatttttggaaaaaccgcctcttctgctgcgagttcggtatcaggaatgggtacggcagcaagtactgctggtgggacattagacttgttcggcggaaagttgagtgggcttgttggaaagtttgcaaatagtgctacgtggacggcattttttcatgagaatttgaagcaattaaatgcagtttctggtgaatcagcagaagcgtatggagcattgattggtacgctcggggaattaaacgatgcgggaagcataacagattctcaattcaatgatttttatggtacattaatggcagctaaagataaaggtgtgaatttcgaagatgctatggcttatgtgcgagatgagcttgataaatctggtgtgtctgcagatgaattcgaaaagagtctaaatgatacacttgatagattaggaacctcggcaccacgtaaagccaaaatagtgggtgccggtataggcgatggtacaaaagaaggcatagagcaaagccgctcgaaagttgaaaatgctatatcaggcttagccgataaaataaaaaaagcatttaccggggaaatggaaatgcattctccatcaaaagtattcttttcttatggtgtaaatacagttgcaggatttaatgacggatttacgagcaaaagttcaagtgcagaacaaaatgttcgttcattgggtgaaaacatcaaaaagtcgatgagtggaacattgaaagggctatccgaagatacgagtgaggcaatctcaggaatacgtgacaagttcaggcaagcggaggggaacgcttcgtcgagtgcgtccagtatcctcaggtctttctcaaacctacatataccgctacctcatttaagtgtatcttttagcagcctcaaagtcggaaataccagcattccaataccgagtttcagggtgaattggtatgcgaagggaggattcccaaatacaggagaactatttgtggcgaatgaaaaaggcccagaaatgctcggtaagatgggaaacaaaaatactgttgcaaataacagacagattacagacggtattgctgcagcagttggacccgctgtgtataatgctgtgacaagtgcgttatcatcatctggaaacggacagggtggtgacttgtatttaacattggaaataggtggagagaagttagttaagaaaatcgtaaaagattataacaatatgaaacaatctgacccaaagttcggattcatatactaaatcccaaagtattatgaaaactctcataatgaaaattgattttgttatgactatgtgtaccagttctacggagattccgatgatatggactctatcgcttacataggccttataatattgggagtggctttttagctgctcctttttcttttaagtttcgctatggcttggtataatattctcatagtttgaatttaaggagaagaagccatgcaaatgattgagttgaaatattatatggatttgcttcctgagtgcaatatatttagagaagatggtatggtagagttgttttttcatgatatggagacgaaggcttattatattgccagagaatttgcgaattcagcagatgaaagttatatggctcaaaacgcttttctggatgatgatacaaaaaactatgttgttaaattcaatcaaaatcggttggaagacattgcatttatgcaatatttatttaatagttcaaataatatgttttcagggtatgcggtaaagagaattcctattgaagacttctatttaggtatggaaataactcctccagcaagatgctttggaaacattgaacaaaaaactaaagaaccattattggggttaaataaattcatttctgaagaaaaggtgatgtatcatagggaactattaagaaaaatttatgagtggtctgacgaagaggtgaattattattccattcctagaagtattcctcataaagataaaatatcgctaactcaaaccgtggcagttgaaagatttttaaatcaaaattatattccatataaaatgcgatatgaggattttccagagtacagtaaattaaaaaagagagattctcaatttataatgaaagcaagacagaaggataatcaaaaattttatgaaatgctttcagactttaaaaagaaatataatgatatttatcatgacttggtcgataagggaactgtaagtcctaagtggaagtcggaatatgaattgtttaaactaatcagggcgttcttcccggatgcagtttttcaatacagatcagaatggttaggaaatcagtctattgatgtattcataccaagcaaaagaatcggaattgaatatcaaggaatacaacattatgaagcaataaatcattttggtggtatagaatcatacgaaaatagaaaaaaacttgattcgaaaaagaagagcttatgtgaaaaaaatggagttattcttgttgaatggaaatatgatgaaccaataaatgaagttgttttgaaaataaaaataaactcttggagttaatttgtatatacagttacggcaatagatgtaagggacatttaccattatggtaggtgttctttttatatataagaaagtgtggtgaagatatgacacagcctcttatcataggtggcattacaatgccatcgcttaaaaaaggcggattaactattacaaaggaaaaagtatggtccggaaacactggaagagcagcagatgggaatgtcataggcgacttggttgcaataaaatataaattgcagtgcgaatggcctccattaagcagggcagatacagcgaaaatcgatcaagctgtgtctcctgctttttttaatgtaacgtttttggatccaggaagtaatacccgtattacgaggacgttctatgcgggcacgcccacatatccagtttacacttatgtgaatggcaacgggattacttataacggggtaaaagtagatttggtagagaaataggaggacgaaatgttaaagacaagcaaaactattaacctgtcaggaaatagcattattaatgataaacaagtagtctacatgcaggcaaatatatctacggatgggggcacaaccagccattccagtagcatacaggataaagtactgtacgaggcaaataaggttgaatgccggaaagatttgtctgatttcgatcagctggtatatgaaatagaagattctattcatacggggggagtgcagtaatgaagattaaaaacagtcaaatagttaatttcataaatgggataatgaatcttaaagagaaaaaacttccaatcaaactggggtatgcgattacgcgtaacataaagatcatggacccggtagcgacctcctatgaggaggaaagatataagatacttgggaaatatgctgagaaggatgattccggtaaattcaaagtagaagacggctcctatatcatttctgatatatcgggatacgagcgtgagatggaggaactgttggaaatcgaaaatgagatgcagctccatacggttacgtttgatgagattgagaagtgcgatttggagcagtttgacgcgttgtcggtacaggacattaccttattggatatgatgttggaatagtattgggggtgagacaatgtatcaatcctcagcggcgtttgcggaattgatacagcaagattcccggacgtttaaaagtaaattaatcattggcgaaaatgaaatagaatcaggcattaaaagtatcgcattaaaagggggctcaaatagtgggtcctcttttattattggaagttgcatcagccagtacatagaagttgaaatggaaaaaccatcagtattcatagaaaacgaagagattgaatggcgcataggagcggatatttcagcaactgtagaagaatttgttccaatgggattttttacggtcggaaagcctgaatccgatgaaaatatggtaaagtttacggcgtttgaccgaatgatgaaaacggagagggcctacttttcttctctgcctgtttctacttcaacagtggctgtactgaatgaaatgtctacgtttttaggcattcccataattaccacaggactatctgctataacgataaagaggccagtcggatatacgtgccgcgaggtactctcctacatatctcagatgtatgctggctttgctatatgcaaccggcaggggcagattgagattaagtcctatgttaattcatcccttcaagtactcccgggaaagtattgggacagttttgttcacaatgattttccgtacacattccagaaaatcgtatgtcatactggaaaagacacagaaggaaacaccatatctatcagcgcaggcagtggaaaccgggagatgacaatatctaatcctctgatgacccaaagcatcttagacagcgtggctactaaactaaaaggcttctcttatatggctggaaacttaaagtttttgggcgatccgcgcatagatccgtgggatattgtcggtgtcagggggaaggacgggacagactacagcgttccgataatgagcataacccaggattttgacggcggtctgtcaacaaccattgaatccgttgctgaatccgaaacggaagagcaacaaggatttaaggggcctgtaacgcaggcaatagagcgttatgccgtacagcttgcattggtagatcacgcaatcgttaataagctggatgtcaatgtggctaacatcacctacgcgaagattgtggatctggacgcaatcaatgcaaagattaccaaaatcgaaacagaagagctgacggcaataaacgcaaaaataaatactgccaatatcaatcttggaaatatcgaaaatcttttgtcggggaatgccggagttggtgatttgacaaatatacatctaacctcccagaatgcagtgattgagagcgcactgataaaaagtgcggtaatgcagtccgtgacagtgaatgatctgctggcgggcaccatctatactaacaaatttcaaatttggtcagatgaagctggcggcatgaagatattcgggtctactcagcagtggatggataaggatggaaggataaggatgcaggccgggcttgatgctgcgggtgcatttaattactatatcgtggatgccgcagggaatacgatgtttgatgcccttaacggcgtgtctgccgcaggaattaaggcacctatcatcaaagactcgatggtggcagatgatgccagtatcagtgggtataaggtcaatgtccagacgctggtgcagaacattaatgggagcaatgtgcagattatggggagtaaagttgttgttgatggaaccagccagaccatatcagcaaagtttgatagcatgcaggaggagattgacagcatatctgcttcaggcggtggatatatcttgcagacctatgtggagggtggtcatacaggtgacggagagacggcaacgatacatgccagactatatgcaagtaataaggaagtgacagagacattcggcccggagcactttgtctggagccgattatcagaagatgattctggcgacagagaatggaatggaaagcagatcacaggatattcgctaaccctgtcgggaagtgatgtaacaatggctgcggattttgagtgtaaattccttatatgggatgaatcaccaatacttgatcacaacggaaacaacatattggatataaacggaaataatattattggtttgacagcttaaaacagtaggaggagaacatgccaaaatttaatgaatatacggaaaaaacaaatccggatgatgtagatatttttttactgcaggatgctgcctcaaccaagaaaatatcttttttgaatatttttaatcggataaagacaaagctagggttgggggatcttgcaaccaaaagcgaggtagcacaatcagacctagaggatgcgctggctaatttaattgctggcaaactcacatcgtctggaattgccaataatctaactacgacagacacgacgaaagtattggcggcgccgcaggggaaggctttattagaatcaattacgtctgcattaacgttgatcgggagtctggacgcattaaccacagccgagaaaacaaatctggttggtgctattaatgagctggttgcatcacttactacactaaatagcaatttaaatgcgtcaaattttaccctgacaaattcgacttactatcccactaccaatgtaattgtaagtggacgcgtggtgcatttacaatgcgctggattgattttaaaggatgtaccggccaatgcagaatttgtcatcggcacgcttccggccgcatatcggccatcgtataaaatcataaaatatgttttaggcggcagcacaacaagccgtttatttaggatatctatagacgtggatggcaaggtaacctacacacctacggcagatatcgcaacaggtgtgggcgttaatatcaatgagacgtttgtggcaaagccatcctaatattccaatttagcaaaaaaaggaagatgaatatgaggacaagagacagaccggcgccggtcttttttaaatgaagaaaataatggagaggtagacaagatatgccagatacagtatttgtggctgttctgtccttggtcggaacgctggccgggagcttcgggggaacccagcttattaaatacaggatagaacaacttgaaaagaaggtagagaaacataattctgtcatggagcggacttttagactagaggagcaaatgaaggtcgcaaatcacagaatacaggatttggaagacgaagagaaggagaaatagaatggatataacatttttaacaaattacataagcccgttaattttagggatttgccttgccgtaggttatgcaattaagacggcagtaccgaaactgcctaatcgcttcataccgctatcggcacttgtgcttggaacaattattgccgtagcaatgaaataccctggaatcaacgctgaggtgatcctgggaggtatgataagcggactggcatcgacaggcttgtacgagatgatgaggaacctgttaaataaagacggcaagaaggatccagagggcaagtaacatcgtcctctttttgttgcaggaaaggagatatctgtaatgggtgaagaaatttacgaaccgaaggaaattacaaaggaagaagttggtgagacaactataggggtgttgttacaagtatacaaggaggaagaataatgagtatatgcggcggcattgccggaagacggggacacagccccaaaggcatattcatacataacgatgcaggcgggcaatttcttgatgcaaactattgggcaaacgccttggcaggtggcgagcatagcttaggtaatggtttcgcgcattattatgttgaccagaatacgatccggcaagtagaagatgatgttaattgcgcttggcattgcggacaggaagacagcaatatgaattatctgtctatggagatctgccagagcatgggattgaaagatacgtttcttgcaaatgaagaacgagggctacagcttgcagcggaattatgcaagaaatacggcattacgccgaatgaaagtacaatcaggctgcatcaggaagtgtttgcgacggcttgccctcatagatctgtagaattgcatggagggccgaaagcatgtaaggaatattttattagacgaattaaggaacttatgaacaatgtgaatgagactcagaaacaaggggcgaatggaaggagagaagtaactatgatgtgtttatatacaattgatggaaaaggtccggtaatcttttttgacgggaaggaatttcaccctcttagccatcctgatgaggtgacgattcttaataagatatacaaagacaataatgggaaggacttgccatgctattcatggagtagtaaggctccgtggcatgcaaggctacaggcagcgatcaagagaatattgaagtaaaataatggcccgggtccttatggattccgggcctaatctgtggcggaaaggacctgagagggtgttcctttccgagctctattttaacatatttgatggttgactggcaataaaatttatatacttataattatcttttgcaaaaaagtaacgcatctgctaatatattgtcataaggagatgaaggattatgatgaagaatactattggaaataatatcaaaaaactcagaaaagaatctggaataactcaagaacagattgcttcaaagctttgtattagtagacaagcgttatccaattatgaaacagggaaaaggattcctgatatttatgagctgatagtattggctgacctttttgaagtatcattggatactattgtaggaaggaaaatatagaaggtggatcggtgagtagattagcttttggcgaaacaggctgagatgactaggtcacgctgatttgacatgcggcagtaaaagtacaaaatgtgattgaaccactgaaagcgcgaatgcgccgtaggtggtgtttttacgttatacggaaactaaaattgctatttagtgaatctaaataaaataactggaaggtgcaaatacagaccctaataaaaaaaagaaagaaggtgatgcgatgtccttaattttggcgtcccgcgcaacagtctatgacagatacgctatctcccgaaagttcacggctcaggagaccgctattaatatggtccagggaaatatcgctcttcttgtatcagcatctgaaatagaagaacttaagaacggcgatcggacaatgtacagtaaattatcggctgtcgaaatggatttgaactcaataaatttggcagtatcatcctcagaatacaaagacattaatggtgtcctcagtgcaataacccaggccagggcatccatagaacttaattcacaggagatacggctaaaagtaagtaaagacagcttgatctctacaataaatcagtctgcagaagcagtaagtatcgatgcaaataagatcaacctaaatggcgttgtaaccgcaaaccagaacttcaaaattctcgctgatggcagcatggaggccaaaaatggaaagttcttaggttctgttaccgtaggcggtattcaggatgaccgaattagtatactaaacgcatcaggggcacaaataggcagatgggataatagtgggatatatgcggaaaactgtgaattcaagtacgctactattggttcagaaaactttcaggtagattttaacagcgggagaatgacgatgtattctgagtacagcggcgtaaaagagtggtatgcaaagatatatcaatcaggtgttgtctcgggcacgggttacttggggctagctatagtggctaaacatgttgatttaagcatagagcattatagaaatggtgctacaagtaacttcagcgtattaaaaggtacgtgggattatagtaagaatgtcggagaaattatcctgggaaccaatgcgtataaagatacaattaatgtagaggtaaatggaaattttagtgtgactggtaccaaaaatagaattgtaaagacaaaaaattttggtacaatagctcaaagctcttacgagactacggagcctatgtttggcgatatgggacacggaataataaatgatcttggagcatgtatcattttcatagatccgaaatatggagaaactgtcagcaccgaatacggatattatgtttttatcacgaaatatgggggcggtgacgcatggatcagcaagaagggagtgagctctttcacagtagtcggtacaccgggactcgaatttgactgggagatcaaggcacaccagaaagggtacgagtttgatcgactaagatctgttgatttgtaaaggcgagaaaatatgaaaatcagagcaagacccttgaggtcttatttttgtgaaaacaatagaaagagagtgagggaaatgaagaaaatggagaaattatttaactggattagcatcgtattcggggcagccggaggggtcttgtcttattggctgggaggctgggacgtgctgctaaagacgatcgtgtttttagcgattgcggattacataacaggatggattaagggtatttacaccaagcaactgtcatccgaaattgggtttaaaggattgctgaagaagattgtaatgtttattgtgattgcagtatcttttgttatccaggggctgatcggcggaacaataccattgcgggaagtcgttattatgttttatatcgcgaatgaggggctgagcctgctggaaaatgcggcagtgtttacgcctataccggataaattaaaaaatgttttgctgcagctaagagacaaggattcgggggacgcaaaataatcgtcctttttactgcggcgcaatgccgaaagaaaggagatttgtatgagcatttgtggaggaatagcgggaaatagaggaaggaacccagtaggtatttttatacacaacgatgcagggagccagaatgcgaacgcagcattttacagaaattggctgcctacacatgatttaggaaatggatttgcgcattattatgtggctgcagatggaattttacaagcagaggacgattataactgtgcatggcactgcggggatatggatggcaacaacaattacctgtccatagaagtatgtcagagcatgggggatttggacaattttaaagccaacgaggaaaaggctcttgccttggcagcgcagaagtgcaagcaatacggcattacgccatcgagcagcacaattagattgcatcaggaggtatacgctacagcgtgccctcataggtcagttgagattcatggcggcagggatgcaactaaggcttattttgtccagaggattaaggcactcatgggaggcaatgccggaagccctaattatgtggagacgcagccggccgcgccgacaccatcttacgctgggacgccaggagtggatttcacgtacatggtctataccgagaatgatggatggctgccggaggttgtgaacttgaatgactttgctgggatccgtgggcactggatcaggaagatagcaattaaagtaaataagggatctataaaataccgcgtgcatgtcatgggcgtcgggtggctaccgtgggtaaccggatacaacaaaaatgaccataacaacggatatgctgggaacggacagcccattgatgcaatcgagatatattatgagaccccggcggactatgcggcgaaatacggctaccagaaggcgcagtacagggtcagccctgtgaatggcggctattggccgtggcagtacgataccgagacatctaacgggcaggatggatatgccggatgttttggacagcctattgaccggttccagattttttaggtataattatagcccgggtccatcaggattccgggcttgaacttttttctaaggaagactatgtaaatacactttattagttagctcattaagattattagaaattgcatctttgtaaatcctatttgctacaatatcagccgctcttattagtacttttttcgaagaattacaaaactgcaagtcaacacctgataacgatggaaaaagaggtggaaaaaatttatcatactgcatattgaatgtaccatttttaaactcttgttctaacccctcacgtaactcgtacctaccgtttgtcgctgtagtatgttcatccataaaaacatatattgtatcgatatttataggagataacttgtcttcagctattaatgtattaagacacttttttattcctattttaaaagcataatcaagatatctctgtttatctttttttgtatcaaagattctatccattaattgacgttgatgtaccactacaccaaatctaatttgtttatttaatgatctgaatatctttcccttatctttattcgatattacgcatgctttgagttcttgacttttcatataattactattttgtcttattactcgttcaacatgattgtattctcttattgcaatatccctggcttgttttcctaaaaatattactcctccaaaaacaaatatctcattatggtttttatcaaatgttcccgactcgtctgcatatatgtataaatccattattttctccttagtacaaaaaaaccgccttccggcggctccatgtccgacgacattacatgtcgcttaaacgttaattcggtttcatggatatacagcatatctctatctgcaactatattatatacgaaaatctaaagaattgtcaacatatagataattttttatttagttttaacaaattttaacaaatataagataagtaaattatggatatacattgtttcactaattgctatatctgcttagaatttaacataatacccggtatccaatcggatccgggccatgtggtggaaaaggagccaaagtagtgaggagtagctcccttatgttaagtaaacaatcttgtaaccttaaacttacggtaattgcgatttagttattattgtaacactatttcttctatattatattcttcttggtacacccgtgattgccgtggagtcgggctatatcactgtcatgggctggaatcagtatggcggatggcggatcggtatcaacagctttgacggtaaaagatattattattacgcacatctccgtcagaatatcccattcgcggaaaatctgaaggagggcgatgttgtccaggcaggtgatgtgatcggttacatgggaagaaccgggtatagcacgacggagaatgtaaataatattgatacttatcatctgcattttggtcttcaactaatctttgatgaatctcagcgggaggggaataatgagatatgggtcgatgtctatcccctggttagatttctttctcagaaccgttcagatgtactgagaaatgatgccaataaagagtggtaccgacaatataagatgaaggatccggcagcagatgcttacataaagagcaaagaagaatagcagctaaaccacagtacaacatagtttggctgtaaaaaacgagatcatagacggataaatcatgcgggaaaacattaaaagacagaaaagataacaaataactataaaaatattgactaattaaaggataagggataatataaagataacagaaaaggcagaagggagtggaagctatgttagaaaaatttatgatcttattcatctccgcagcagcgttggtgatcgtctgctggatacttgcagaatactggctccgctctgtcaggaagctttcagtagagaaaatttccaatctgagcatctggaacagaatggtatacgctttcgaagatttctgcggaggagtaaaccataaaaaagacttccgcaggatgcggatcggagaagaactagggagcgtacacagagacgaagaaatcagtcattacagacaggcggagacatgcaggaaagaagactgcagagagaaagacatcttcaaaaaagagagaaaatacaaaatgaaggcaaatatgtagtgcggctaaaatcgaccccctcataaagaggaggctgttacagaaacctgttttccgtaacagcctcctcttattagtttatggcaatcatttccagcaagtttttaatactataattgtatcatctatgaattgcttatttataaaataccggtctatgatttataattgatcatttttaaataataattttatataaatattgacaaaaagagtacgactgcatattataaatagaaactctttgcactgcatattataactacagtacaaactgagcaggttatgtaacacatgaccgggccgccagacagcggcagcagataaaagacatctgcggaacagttttcgttttttgttccgcaggtgtcttttttgtgaatattctgaaaatggaacgcaaaggggtcagaccccttgggaggctaagtatgaatgaaccaaataagatcgctatgcgcgtctcaattgtaagcattgtggtaaatgtcattttgtctgtttttaagctgctggctggcctgctggctggctcgggtgctatggtgtccgatgcgattcattcggcatcggatgtcttcagcacggtgattgttataattggggtgactatatccggcaaaaagtccgataaggagcatccctacgggcatgacaggatggaatgcgtggcttcgattctcctggctgtggttctgtttgcgacagggcttggaatcggagtaaatgggatagaaaagattgcggggggcgggatggaatcggcagcagcccctggcagactggcgcttgcagcagctgtcatatcaatcgttgtgaaggaatggatgtactggtatacaagggctgcggcaaagaaaattaattccggtgcgctgatggcggacgcgtggcaccatcgttcggattccctctcctcgatcggagcttttgcggggatactgggtgcccgcctgggatttccggttctggatccgctggcaagtattattatctgtatatttattgggaaagcttcctgggatatcttccatgatgctatgaacaagatggtggataaatcctgtgatgacaggacaattcaggatatgagacagtcagtcttggaaaaccctggggtagcaaagattgatgaaatgagaaccagaatgtttggcgcaaaggcctatgtggatatagaaattgctgcggatgggaatctgacattaaatgaagcgcataaaatagccgaaagcgttcattcgaggattgaaatggagttcccggaagtcaagcactgtatggtccatgttaatcctctgaatgaaagggcgatgaaagaactgccatagacagcctttcctgcgtatgttatacttttaaattattatgatacataaaatcaactcgaagggagcatttatggattttcttttacagctagacggaaatatcttactcgcgatccaggaatatatccggcatgactggatggattccttctggaagtttatcacgtcactcggagattcaggctggttctggcttacggtctccctcctgctgctgatcccccggaagacgagaaaagcagggattaccgctatagcggccatagcaatcggagcgcttattacaaacgtaacacttaaaaacctggtagccaggacccgcccatacgaagtcgtggagggactgactctcttaatagggaagcagcatgattattcattcccatccggccacacatgtgcatccttcgccgcggcgcttgtctattaccgtatgcttcccagattctggggcacagcctccgtaatactggcggccctgatcgccttttcacgtctctacgtaggagtacattaccccagcgacgtaatagccgggctgtttataggagcattcgcggcatgggcagccgccaggataattgcggatgtcgagaagaagggtgcggagcgccgtaaagaaggtgagcccggctcccactgaagggtacagcatattaaaacccttgtaaggaactaatcagggatgtgaaaaaaacaatcagtcaacagcaaaaaacatcttcatccaacaatatccgcattagccaatccaatccgcttctcccgctgaatctccccgaggagtggatcactaagccaggatgaacctagcctgcacgtgcagagacctccttggccccgtacgtgcaggcgtacactttactccccccgcatcccactcctcaaatgagccgcctccacaaaccccttgaagagaggatgcggcctattcggccttgattttagttctggatgcgcctgtgtcgcaatgaaccagggatgatccggaatctcgagcatttctacaatcctgccgtccggtgaaagcccggagagtatcatgccgtgctcttccagcgcctctcggtagtcgttgtttacttcatagcggtggcggtggcgctcttggatttcttctttcccatataaacggtatgccagtgaatcctttttgagaacgcaggggtatgagccaaggcgcagagtcccgcctatatcttcgatgccgatctgatccggcatgatatggatgacggggtgggtagtgtcaggctgcagttccatactgtgcgcatcgttgtaaccgagaacatctcttgcaaattccacgatggaaagctgcatccccaggcagaggcccaggaaggggatgcggttggtccgggcataccggattgcctcaatcattccttctatgcctctgtcgccaaaaccgccgggaacaatgattccgctgacatcgctgaacacctctgcggcattatccgcagtgactgtctcggagtccacccatttgatattaacggtcgtatggctgtagattccgccgtgcttcagcgcctcaacaacgctgatgtaggcgtcatggagctggatatattttcctacaagggcaatgtgaacctcctgggttggattgcggaggttgtccaccatctcggtccaatctttcagatctggttccggacagtcgagatgcaggcattcacatgcaacctgggccagattttcccgttccatggcgaggggagcttcgtataaatattcaacatcgaggttctggagtacatgatttgcaggaatattgcagaataaagagatcttatccttcatgccggcgtccagaggatactcggagcggcagacaatgatatccggctgtatgcccattccctggagctctttcacactcgcctgggtcggctttgttttcatctcctgtgaggcttttaggtagggaatcagggttacatggatcagaataacgttatcacggcctttttcgtgctggaactgccgtatggattccagaaaaggctggctttcgatatcgccgacggttccgccgacttctataatggcgatctcagtgtctttggcagcaggattgcggtaaaatctgcttttgatctcgttggtgatgtgaggaataacctgtaccgttccaccgccaaaatcaccacggcgttctttctgtaagacagaccaataaatctttcctgttgttacattggaatttttcgtcaggctttcgtcaataaagcgttcataatgtcccaaatccaggtccgtctcagcgccgtcatccgttacgaatacttcaccgtgttgtaccgggttcattgttccagggtcaatattgatataagggtcaaacttctgcattgtcacagtatatccacgtgccttcaacaggcggccaagtgacgcagcggtaattccttttccgagtccagaaacaactccaccggtaacaaatacatattttactgccatataatcctccttgtatgaaatctgtgcctaaaaaaatacttaaagagtatacaccaatttctacaaaaaatacagttttttttcaagtacatggaaaaacacttggagaaaggaagcagccgttcagatttgtctgaacggccgtttgattagtggtaaatatggtctgtctcgtaaacagcctggcaggtgagctgtacgcccagctttttgaaggttttgatatccacatccgaaagcatgaccgaggtgtgtgcctgacagccttccagtttcggcagctgttccagcgcttttcgggccatattactgttggcggcgctggcggaaagggcgatcagaacctcatccgtatgcaggcgaggattcttgcttttcaaataatcgaccttgagtttctggatcggctcaatggattcaggagaaataacatgcagttcgtggtcaattcccgcgagttcctttaacacatttaaaaggagagccgcagaggcgcccagcagattggttgtcttgccggtgatcatgcgcccgtcatccagttccatagccgccgcaggcccgttcgtctccctggagcgttccagagcctttgcaaccacttggcggtcctggacggagacattcgcctggttcatgaggagttcgattttctgagcctcctcctcggaagttgtccccatcaataaagaattcagtgatgcaaaatatctccggacaatctcctgccgggatgcctcacgacagatttcatcgtcgcagatacatttgccggccatgtttacacccatgtcggttggggatttataggggctttttccgtaaattttttcaaaaattgtgtttaaaacagggtaaatttccacatcccggttataattcacggtagttacgccataagcttccaaatggaagggatcaatcatattgatatcattcagatccgcggtggcggcctcatatgcaagattaaccggatgcttcagaggcaggttccaaatgggaaatgtttcaaatttggcatagcctgcatgaattccacgtttatgctcatgatataattgtgacaggcaggtcgccattttcccgcttccagggccgggagcggtgacaatcacgaggggacgggacgttacaatataatcgtttttgccgtatccgtcatcgctgataatcagagggatattagaaggataaccgttgatgcagtaatgcatgtatacagggatatccaaattctcaaggcggtttttgaagaggacggcgctttcttgtccggaatattgtgtgatgacaacgcttcctacataaagaccgttttcacggaaagaatccatcagccggagaacgtcggaatcgtaggtaatgcccagatctccgcgaaccttatttttctcaatatcacgtgcgctgatcacgatgacaatctcagcctggtcgctgagctgcttcagaaggcgcagtttactatccggagcaaagccaggcagcactctggcagcatggtaatcatcaaataattttcccccaaattcaaggtagagcttgttgtcgaactggttaatcctctcgcggatatgttctgactgcatagataagtacttttcattatcgaatcctattttcattttcacattccttttcatgacatatttcgttctcagtatactataaaatgccctgtgtttacaatattttcataatctttttattgatttatatggaacctgtacttataatggggatagtggattttaggaggcatagaatggacaatcagaataacaagaataataataatcctaagaacaataagcaggggtggggagtgattctcgtaaccacgctgctgactgtttttattgtaatgggattgtattcaatgatgcaggacaagaatcctgcggagttgagttacgatgagttccttacaaaggtagatgacggagaaattgagaaagtaacgattgattcatcaaagttatatgttactttaacagatgaggcaagaaaaaatgagaaatcggataaaaagactgcgggcggtgatacgccgaaggacgcgtcggatctgatcaatcagcttgaacaaaaaagcggagaagaggagcgggcaccggactattatgttgtccgtacagctgatgaaaaactggtggaacggcttcataaagcgggggttcattttgagcagcagatgcccgacacagcctcttctatgatatttgagatatttatcaccgttgtgctgccgatcattatgatcgtaatcctgttcaatttcctgatgaaacgaatgtcaaagggcggcggaatgatgggaatcggcaagagcaacgccaaggtttatgtggagaaggagactggcgtcacttttcaggatgttgcaggtcaggatgaagcgaaggaatctctgcaggaggtggtagactttctgcacaatccgggcaaatacacgggaatcggtgcgaagctgccaaagggagctctgctcgtcggccctcccggtacggggaaaacgctgcttgcgaaggcggtggcaggtgaggcaaaggtaccgtttttctcactgtcgggttctgcatttgtagagatgtacgttggtgtcggtgcatccagagtgagggatttgtttaagcaggcacagcagatggcgccgtgtatcgtatttatcgatgagatcgatgcaattggtaagacacgtgatacggccatgggcggtaatgatgagcgtgagcagacactgaaccagcttctggcggagatggatgggtttgataccaacaagggccttctgcttctggcggcaacgaaccgaccggaggtactggatccggcgctgttgcgtccgggccgttttgaccgccgcatcattgttgataagcctgacttgaaggggcgtgtggatgtcctgaaagtacattccaaggatgttaagatggatgagactgtggatctggaggcgattgctctggcaacctcaggtgcggtcggttccgatctggccaatatgattaatgaagctgcaattaatgccgttaagaatggacgacatgtggtcagccagaaggatttgttcgaggctgtagaagtggtgctggttggtaaagagaaaaaagaccgcattatgagtgaagaggagagaaagatcgtatcctaccacgaagtaggccacgcgctggtgagcgccctgcagaaagatgcggagccggtgcagaagattacgattgtgcccagaacgatgggcgctctgggatatgtgatgcagaccccggaggaggaaaagttccttaataccaaaaaagagctggaggccatgctggttggtgcactggcagggcgtgcggcagaagagcttgtgtttgatacggtaacaacaggggcttccaacgatattgaacaggcgacgaagattgccagggcaatgatcacacagtatggtatgtccgacaagttcgggctgatcgggctggaatcaattcagaaccgctatctggacggacgtccggttatgaactgcggggaagccacggctgctgagatagacggcgaagtcatgagcatgctgaaaaatgcttacgatgaagcaaaacgtctgctgggtgagaacagagaagcactggaccgcatttctgcattcctgatcgaaaaagaaacaattacgggaaaagagttcatgagaatattccgtgaagttaagggaattgaggagccggaacagggtgaggaaataaaaaaagaagtgcgtatcgctatgaagccagttgagggagaggcggacgcgcagtaaccgtttaggcctgcctgaacggtaccacaaggaatccggaggataaggaaagttagaatggatacttgaaaaaagttttgccggcatgtataatttatctagtacattaaaaaataagttaattattattcagtgtactaggcttaatcagtggattgccgttcagtgattgccgataactgttctttacagttatataagctatcctctctgccaagaggatagctttttgtataataggaaagtgctcggcacttttcaattatataaaaccctccgggggggggatgcacatgccgcattaaactaaatagccgcaaagcggcatcgcggcggtactaaagtgtgcaggctcactttgattttgattctggaattctattttcacttcctatattttcccttcacaaatccctcgttaggccttataataaatggcatggataattataattttgacatacaggaagaactgaaaaagctcccggcgagcccgggagtttatattatgcatgatgaaaaagacaatatcatatatgtgggaaaggcaatcagcctgaagaacagggtgcgccagtattttcagagcagcaggaataagggggttaagattgaacagatggtcactcatatccgtcggtttgagtatatcgtaacggattctgagttagaagcgcttgttctggaatgcaacctgattaaagagcaccggcccaagtataatacgatgttgatggatgacaagacctatccttttatcaaggtgacgaccaacgagccgtttcccagggtgatgcttgcgagaaagatgctgaaggataaggcaaagtattttgggccttataccagtggtctggcggtccgggacaccatagacctgattcataagctttatcatgtgaggagctgcaatagaaatctgcccaaggatattggaaaagagcggccctgtttgaactatcatattaagcagtgcgatgcgccgtgtcagggatatatttcccgggaggaatacgggaaatccatccaggagatcatacggtttttgaacgggaatttcgacagtatactgaatgacctggaagagaagatgaatgcggcctcggaggctctggaattcgagaaggcgattgagtacagggagctgctgaacagtgtgaaaaaggtatcccagaaacagaaaatcacggacagcagcggagaagaccgtgatattcttgcggtggcatccgaggaggaggacgctgttgtacaggtgttctttatccggggcggaaggctgatcgggcgggatcatttttatctccgtatttcaaaagacgaacaggaaagtgagattctagacagttttatcaagcaatattatgcaggcactccatttatcccaggagaactgatgcttcctgccgagctggaggatgtgcacctgctggaggaatggctgagtgcgaagcgcggaggaaaagtgaccatccgggtgcccaaaaaggggacgaaggaaaaactggtagaactggcggcaaacaatgccagtctggttctgagtaaagacaaagaacggctgaagcgcgaggagggcaggacaatcggtgcggtcaaagagattgcccgccttttagatcttgaagacatcagccgtatggaggcatttgatatctctaacacaaatggatttgagtcagtcggctccatggtggtatatgagcgtggaaaacccaaacgaaatgattaccggaagtttaagataaaggggatccagggggccgatgactatggcagtatgagagaggtactgacaagaagatttaggcatggactaaaggagcgggaagagagccgggaattgggcggttttactgcatttccggacctgatccttatggacggaggtaagggacaggtaaatgtagccctgcaggtactcgaagatctccgcctgaatattccggtatgcgggatggtgaaggatgattaccacaggacaaggggattatattaccataacgaggagattccgattgataagtcctctgaggcgttccggctggttacccggatccaggatgaggctcaccgttttgcgattgaatatcacaggcagctccgtggcaagggacaggtacattcgatactggatgatattgacggcatcgggccggccagaagaaaggccctcatgcgccattatatgagcctggatgccattaaggccgcatcggcggaggagcttgcgaaagttccctccatgaacgaaaaatcggcagaagcggtatatgcttttttccatcatgcaggggagcagaaagaggaactagaataactacttacggggcagtgcacggtaacgatttaaatacgaggaattaaatgcattttgatagagcttttatgaaactatggtttatggtataataaccgcatgaggatcaatctgccgtcggatggaagcagttttgtgcagatttgtgatgtctggctgtgcagtgaatataagagaaaaggagatagctatgggacatggtgtaaagctacaggaaattgtcgagaaaatgaatttaaagaatctgacccccgaggttgagcttttagggcgggaggtgaatgttccggatatcaacaggccggcgctgcagcttaccggattctttgaccattttgactgcgacagggtacagatgatcggatacgtagagtacacatatctgcagacactggaggaggaaagaaagcttcagatatatgatgaattcctcagccataaagtgccgtgtattattttcagcagagacatggaaccggaggagatactgcttaaaaaagcagtagagcatgatgttcctgtatttgtaacttcaaaatctacgtcttcatttatgggagaaattatcagatggatgaatgtaaaactggcgccttgcatatcgattcatggcgtgcttgttgatgtatatggtgtaggtgttttgattatgggtgagagcggaatcggcaagagcgaggctgcactcgaattgattaagcggggccaccgcctggtgacggacgatgtggtggagatcaggaaggtcagcgacgatacgcttgtcggagctgctcccgatattacaaggcattttatagagcttcgcggcattggtattgtagatgtgaagtccatgttcggcgtacagagtgtcagggaaacccagaatatcgacctggttattactctggaagactggaacagggacaaggagtatgacagacttgggctggaagagaactatacggaatttcttggcaaccgtgttgtatgccatagtattccgatccgtccgggccgtaaccttgcaatcatagtggaatccgcagcggttaaccacagacagaaacagatgggatataatgcggcacaggaattatacaaacgtgtccaggaaaacctgacaaaaaacagatagtcagcatagaaaagatactaatcacggcttaggccgtgattagtaacatagagaattgaaatcagacaggagagttaacatgaagtattgttttggcatagatgttgggggaactaccgttaagatgggattattcgaggagaggggaaagatccttgataaatgggagattgtgacgcgcacagaagaggaaggaaaagccattcttccggatattgccgcatcgattctggaaaagattgaggaaaagggactgaagaaggaagatatcgtgggagtgggagtcggcgtgccggcccctgtaacagaagaagggattgtagatggcaccgcgaacctgggatggaattataaaaatgtcagaaaagagctggaagagcttacggggctgtacgcacagattgggaatgatgccaatgtagccgcccttggagagatgtggaaaggcggcggagctggccagaagaatatggtaatggttacactcgggacaggcgtcggaggcggagttatcatcggcggaagagtgctgaccggtgctcatggagcgggcggtgaaatcggtcatatctgtgtgaattatgaggagacagacacttgcggctgtggaaaccacggctgcctggagcaatatgcttcggcgacaggaatcgttaggctggcgaaaaagaaactggtagctgagacgagaaacacaatgcttcacctggaaagcgtctctgcaaaggacgtatttgatgcggttaaggcaggggatgttgtggctaaggagattgcggaggaatttggccagtatcttggccatgtccttgcaaatctggcagttgtgacagatcctgcagtctttgtaatagggggcggcgtgtccaaagcaggagatatgctgattccttacattgagaagccataccttgaacgggcattttttgcaaataagaatgtaaagtttgtgctcgccacactgggtaatgacgcgggtatttgcggtgcagctaagctggtgctgggggatcgggcttagagggatatggcagtgggcctgcggtatggaagcaaggcaggtctattgaaatgtagtatggcggtgcaacagccgggaataaaatgaaagccaacatgttcatcatgctggctttcattttattcccggctgttatgccgtaaaagacggatctatcagtgttctgttgcgaaggaattattcggcaggaggttcttctccgcctccggcatccggcgtttcggctccaccaccttcattaccgccgccttcattgccgccgccttcgtttccaccgccttcattgccgccgccttcattgccgccgccatccggcggtgtgacacttcctccattttcatccggattctcgggattttcattctttttatcatcgtctttgtttttatctttgtctttctcgtcgtcctctttttcctctttcggcacatagtgtccggaacaactctgtgacggagcggttccttttgcaaagtattcggtcagaggaggacaggttgccgtagccagtaacccggtctgcgtacagatagtcttctgttcaacggaggaaggcatagtgaaatctttatactccagaccttcatgaacccgttccatgatgttcttccacataacctcatgccatgcctgatccatattgctcatcggcttattagagtcgtagccgccccagacggaacatgtgtaatatggcgtataagcggagagccagaggtcagtactgttttcggttgtaccagttttgccggctgcaggcatgctgtataatcttgcggcagtacctgtaccacgggtgataacgtcctgcattgcacttgtaagaagcgctgcagttgagtctttaatgacctgatgagttgcaggtttggtgttgtccaggagcacattcccgtccttgtccagaacctttgtgtagaggatcggctctgtgtaggtaccgttgtttgcgatcgctgcatatgccgcggtcatttccaggttgtagataccgcgtgtgattcctccgagtgctgtggcctgtgccacatcggtgaatcccggatagttgtcatcgtcgttattcaccagagtggtaaatccaaagttcaacagatagtcataacctgtctgtgggccgatggctgtcagtgtcttaaccgcgcagacattcatagaatgctcaattgcataacgcacgcgtgtgctgccgatatactggtgatcccagttgttcacgggttttccgctcgcatagctgaaaggctcatctacgattgtagttgcaagtgtataaccgccagagtccatggcgggcgcataggttgataaaattttgaagcaggaaccgggctgtcttgtcgaatcggttgctcggttaagggaaaggctcgttgtcttttcaccacggccgcccacgattgcctttaccttacctgtatattgatccatcaggaccacggaggtctgaggctgcggggtgatatctttattttcaattatggtatcttcttctgtaatgccaagtgtgcctttatattccgcaattgcctgttcagcttcatcaggggaggagaatactagcgggaattctcttccccatgcgttgcggatatactctccaagcatctccttgctgtaattatctgagtttccgtcaggatgtgtaacagtcaatgcatattcaagtccatattcaacggtgtagggataattgttcggattggcaacctcctcgtcacagatattctggattgcaagatcctgggttgctgtgattgtcaggccgccgctgtaaagcaagttatatgcctgcgtctcagtataacccttgcgttccctgagatcgtggatgatctgctgtgtaagctcatcaacaaaataggaatatggggtgttatcggtagcatcctgtgaagttgctttgattctgtcatataccggatcggctttggcctcatcatattcttccttgctgatatagccctgatccagcatgtttttcagtactttatcccgcctctcggcattagcctccggaaaattcaccggatcataatccgtaggattctgtgtaatacctgccaggacggcacactcggagaggttcagttcggatacgtccttgtcaaaatagcgttttgccgctgtctgtacgccgaggcagttctgcccaaggttgatggtgttcatataggcttccgctatttcttctttgctcatctgcttttcgatctcaacggccagatactgctcctgcagctttctttccagcctgtcatagaatgtcttctcttctgtaaaattcgggaatacgttgtttttaatcagctgctgggttagtgtacttgcaccctctgaaaaattacccgaggtcacgccgacaacagcggccctgaggataccctgcatatcaatcccgttgtgcttgtagaaacgttcatcctcaatagctacaaatgcatgcgtcagattgatcggaatgtcatcgtatgatttatagacacgattagatcccttttgacggaacttatccaaaagttgtccgtcttccgtgtaaacaaaggaagtggctccggagggcttgaccatgttaggagtcacttttggggcatcatctataatttttttgacaaacagaccgactcctccggccccgattactgcaatgagtaagacgcagatcacaagagctttgaaaaaacggacgccaacccgcttctttttcatattcttttttgaagagatattcttctttctcttatcgagattttcttttccgtaattcatgaatcatatcctcctttaatcattccactcattatatcaaatttacctgcttaaataaagaaaaaataggaaaagttcatatttctaaaaaaatcttaataatttcttgtggttttctacagttctgttatattctatttatgattactaaagaaaccgaggtaaagccgatgaactataaaacagtatatcagggagcctctgcggaaatcgtcgaaaaaaagtcacgtttcatagccgatgtatttcctgtctcttccgcagaagagacaacggagtacctggaaaaagtaaaaaagcagtactgggatgccaggcatcactgctgggcctatgtaatcggtgttgaaaatgtacaggagcgctgcagcgacgacggagagccgagcggaaccgcaggcaagcccattctcgaggttataaggggacagggcctgcacaatgtgctgattgtcgtcaccagatactttggaggcacgctgcttggaacaggggggctggtgagggcatacacagcagcatcgcgggaaggcctgtctcacagtaagattataaccaggatttacggatttaaactgaaaataagcacggattacaccggcctgggaaaaatacaatatctgcttgcacaaaaaaatatcccgctgctcgacaccgcatataccgactccgtagatatcacagcccttgtatcccaggaggaagaaaaacatatcaccaaagaaatcatagaaggaacaaacggaaaaagccagatccaaaaagagggggagtgctggtatgcggttgtggagggggaggttgtttttgagtgatggggccgcatcaaggcaaaagagttccccctgccgcttggggagcagcggcgggggcagcggatggagcatcctgggtgcggcagattgggagggccagggatgtcagggatggaaagcgtaccgcatacccaattcaatccggccctaccgtcagatccccccaaaaagcggaggttctgcagccggatgaagcccactccacattccgcttaggcgtccctcagccacaacagcccccgctcccaaaatctaatcgaattcaggttctatgagtccaaatgacccgtctttccgtttataaactacgtttacctcatctgtctcagcattgcagaatacgaagaaggaatgccctaccagatccatttggatgcaagcgtcttccggatacattggcttgattccgaagcgctttgtccttacaatgcggatctcgtcatcctgctgttcgctgtcttctgattcaaagaattcttttttgaagttgcttccgccggcagaggctgttgggtgcccctggctctttgcaaccagtttatttttatacttgcggagctgtcgctcgattacttcctctacgaggtcgatggatacatacatatcattgcttgtctgctcggagcggataatatttccctttaccgggattgttacctcgatcttttgtctttctttctctacactgagcgttacgataatttctgtttcaggagtaaaatacctttcgagttttcccaacttgtgttcaatagtgtcttttaagcctggtgttacgtcgatgttctttccactaataataaatttcatgatgctcaactccttttgttcatattatacagacagtcgtgtgtttactgcttgtattatgtaaatattatagcatgtaaaaactttattgtatagaacgaatcacttcaattcttctaatttttcccaacgtaagctttgccattcggagcccaaactgtggggaattgatgcatgcactaaacgaatacagaacgaggggggatgattgtatcttattgtaaaatctacttataaaataaaaagtcctcccggcgggaggcgctctgtggcgagagagacagatgccgcagtgcggccgccacaggcgcgtgtttcataagcctgattctattttgcattacttcttttgcgcattctggaatccaggattttcttgcggatacgcagtgactgcggcgtaacttcgagcagttcgtcggtatcaatgaaatccagcgcctcttccaggcttaatatgcgcggcgtagtgagccttaatgcttcatccgcgctggaagaacgggtgttggtcagatgcttggtcttgcagacatttagttcgatatcttcagctttcccattctggccgattaccatacctgcatatactttttcaccagggccgataaataaggtgcctcgctcctgggcgctgaataatccgtaagttacagactccccattctcaaaggcaatcagggaaccctgcttgcggtactgaatatcccccttgtagggcgcatagccgtcaaagctggtgttgaggattccgtttccttttgtatcggttagaaattctcctctgtatccgatcagccctctggatgggatggaaaattccagacgtgtatagccgccgttggaggcgcccatgttctgcagttcccccttgcgctggctcagcttgtcgatgacggttcctgtgaattcgtcggggacgtccacataggcaatttccatgggttccagctttttgccgttttcatccgtcttgtagaggacctctgccttgcttacggcaaactcatagccttcgcgcctcatattttcgatcaggacagacaggtgcagctcgccgcgtccggataccttgaagctgtctgcattttccgtttcctccacgcggaggctgacatcggtgtttaactctcggaacagtcggtctctgatgtggcgggaggtgacatattttccctctttgccggcaaaagggctgtcattgacgatgaactgcatggatattgtgggctcggagattttctggaaaggaatcgcttccgggcagtcgggagagcaaagggtgtcccctatggaaataccggagataccggaaatggctacgatagaaccgatgcttgcttctttgacttccaccttgctgaggccgtcgaattcgtacagcttgctgatctttaccttttccagtttatccggatcgtgatggtttacaagtaccatatcctggttgacggaaatagtaccgttatctacttttccgaccccgatccgtcccacgtattcgttgtaatcaatggtactgatcagtacctgtgtcggtgcttccgggtcgccttccggcgccgggatatagtccaggattgtttcaaataaaggctgcatgtccttctcatcatcagtcaggtccagcacggcaattccggacttggcggaagcatagatgaagggacagtccaactgctcatcggaggcgtccagatccatgaaaagttccagcacttcgtcgatgacctcgtcgggccttgcctctggcctgtctattttattgatgcagacgataacaggcagttccagctccagcgccttgcgcagcacgaatttggtctgtggcatagccccttcaaatgcatccacaacgaggatcacgccgttgaccattttgaggacgcgctctacctcgccgccgaaatcagcatgtccgggcgtatcgatgatgttgattttggttcctttatagaagacggcagtatttttggagagaattgtgatgccccgttccctctcgatgtcattggagtccatgacacgttctgcgacttcctggttctcgcggaaaacaccgctctgttttaaaagttcgtcgaccagggtggtcttgccgtggtcaacgtgggcgataatcgcgatatttctaatatcttcacgttttgttttcataattttcaacactctttcctacttatgttatgtggttacaacttttttattctatcacaaaaaattacggaagggaaggtacatttacagaaagaagcgggagcggaagctcacatatcactattcacggggccgtgcaccatgctgcacggcatccgggacagtaaaatgatggagcgggcatctggagcttcgccacagtaactctaaatttacgatattcttcatggtatttggacaattttcgcctggatcttaaaactttgtcgaacgattcagacctgtttttcgttctaaagcataagtcatgttcatagacttagtattgactcaaaaataccactcagaggaagggagaactacaaaattatgtcagataagattattgaaaacaatcaggtaacaatcatgggcgaggtggcttcaaaattcacatacagccacgaggtattcggagaaggtttttatatggtggatgtgcttgtgaaaaggctcagcaattcagatgaccggattccgcttatgatttcagagagactcattgatgtgacccaggattatacaggggaattcattatggcctccgggcagttccgctcttacaaccgccatgaagagcagaagaacaggctggtgttatctgtatttgtgcgggaagttgagtttatcgacgaggagctggacggggcgaagacaaaccacatactgctggagggatacatatgcaaaaagcccgtgtaccggaaaacaccgcttggacgtgagatcgcagacctgctgctggcagtgaacaggccttatggaaaatcagattacattccatgcatctgctggggcagaaatgccagatatgcatccggttttgaggtaggagagcatgtgcagattctgggcagaatccagagccgggagtatgtaaaaaaattatctgagacagaaacggagacacgcatagcgtatgaagtatctgtaagtaaacttgaatgtatggaagattaaagatagaaggaagaaggagtgtcattttgtaaaatgacgctctttctttacgttgacatcaaccatttttaatgttaaactttggaagagataagcgaattagattaggaggatgtatatgtcaatttttgaaggagccggcgtggctttgattaccccatttaaggcagatggcagtgtgaattatgataagctcgatgagttgataaactaccactgtgagaatggcacagacagtattattatttgtggtacgacaggcgaatcttctacattaaccgaagaagaacatatggattgtattaagtttacgatagagcgcacgaagaaacggattccggtaatcgccgggaccggatccaactgcacccgcaccgcggtggagatgtcaaaggaagctgcggaggatggggctgacggcctgcttgtcgtgactccttactataataaggccacacaggccgggcttgttgcccattataaggcgattgcacaggaggcaaaggctccgatcattttatacagtgttaagagcaggaccggcatgaatattgaaccggctgcggtagcgcagatggccagagaggtggagaacatcgtggctgttaaggaagcgtccggggatatttcccagattacgaagattatgcagctgacagacggaaagattgacctctattccggcaatgacgatcagattatacctttgatggctctgggcggcaagggcgttatttccgtattggccaatattgcgccgagagagacgcacgatatctgtgagaagtttttcaagggagatctggaaggcagccgtgcacttcagctcaaggcgctgccgctgatcgagcagctgttctgtgaggtgaatccgataccggtcaagaaggcggcgaatcttatgggtatggaagtaggcggcctgagaatgcctttgacagagatgacggaaaaaaatgcggcaaatctggcaaaagcaatggctgatttcgggattaagcttgcttaatcaggtaaatatatgattgtgaaagggatatcatacgttgagtaactggctcaaatgtggtatccttttttatatagagggactcctttgagagttccgtacattatatgaaaaggctcgggagggacagatatgataaaggttttaatgcatggctgcaacggaaagatgggacagatgataacaggactcatcagagacgatgaacaggtggagattgccgcaggcgtggatgcttatacagggcttgctaatgactatcctgtgtttgagagtgtggattcctgtgatgtggatgtggacgtggcgattgatttttcaaacgccggagcggtggacgggctcctggactattgtgtggaaaagcaggttcctgtggtgctctgcacaaccggcctgtcaaaggaacagctcaaaagggtcagtgaggtctccaaaaaggtcgcagtgctgaagtctgcgaatatgtccatgggaattaacttacttctgaaaatgctcaaggatgccgcgaaggtgcttgctccggcgggctacgatattgaactggtggagaggcaccataaccagaaggtggatgctcccagcggcacggcccttgctcttgcagattctatgaatgaggctttgaatcatgaatatacttatgtatatgacagaagccaggtgcgcaaaaagagggagaagaaggagatgggcatctcagctgtccgcggcggtacgattgtcggggagcatgaggtgatttttgccggcccggacgaggtgatcgagttcaggcatacggcttattccagaagtgtttttggaaagggtgcagtggaggcggccaaattcctggcaggaaaagaggccggtatgtatgacatgagtgatgtgattcaattttaacatgataaacgtggattgaaaccatcacaatgtatggggaggaagtattatgaaagatctggaaacaagatatcttgagcggctttctgatttatatccgacgattgccgcggcttcaacagagattattaatctgcaggcaattttaaatctgcccaagggaaccgaacattttttgacagacatccatggggagtacgaggcgtttgcacatgtgctgaagaatgggtctggttcggtaagaagaaagatagatgatgttttcggtaataccttaagttccagggacaagcagtccctggctacgctgatttattatcccaaggacaagatggcccaggtgaaaaaagtggagagcaatatggaggactggtacaagatcaatctgtaccgtctgattgaagttagcaaacgggcggcgagcaagtatacgaggtccaaggtaagaaaggcgcttccgaaggattttgcatacgtgatcgaagaactgattacggagaaagtggaagtaaatgataaggaatcttattataatgagattattaagacaattatccgaataggccgggcggaggagtttatcgcggcgatttcggagctaatccagcgtcttgtcgtggatcatttacatattgtgggagatatctatgacagaggcccgggcccccatatcattatggataagctgatgacctatcactccctggatatccagtggggcaatcacgacgtcctctggatgggcgcggcagcagggcagagaggctgcatggcgaatgtggtgcgtatctgtgcgaggtacggcaatctggatattctggaggacggctatgggattaatctgcttcctctggctacatttgcgctgcggacttacggggatgacccgtgcacctgctttgcactgaaaggaccggaaaaggcaaataaggcggagatggagatggatcttaggatgcacaaggcgatttccattatccagtttaaggtggaggggcagattataaagcgccataaagattttgggctggatgacagggctcttctgcacaagattgattttgagaaagggacggttaaccttgacgggacggattatcctcttctggatacgaattttccgacgatagaccccaaagatccctataagctttcggaggaagagaaagagatcatggagcgtatggagcgcgcatttctcggctgtgagaaactgcaggaacatatgcgttttctgcttgcaaagggcagcctgtacaaggtttataatcataatctgctgtatcatggctgtgtgcctttaaatgaagacggcagcctgaaggaagtgtgtctgttcggaagaaagtttaagggaaaatcactgtatgatgccctggaccggtatttgagaaaaggattttttgcattgaacgagagggaacgggaggacggcaaggatatgatgtggtatatctggctgaatccgaattctccgctgtttggaaagaataaaatggctacatttgagagatacttccttgcagagaaggaaacacatgtggagaagaagaatccgtattattatcttctcgagaaagaagaggtgatcgacaatattatgcgggagttcggtctctgtccggatgaagcgcatgttgtcaacggtcatgtccctgtaaaatgcaagaatggagaaagccccataaaatgcaacggcaaggtacttgtgattgacggtggattttcgaaggcttaccagaaggagacgggaattgctggttatacgttgatttacaattcttacggactgcttctggttgcccatgagccttttgaatccacagaagcggcgatccagaaggagagcgatatccactcggattatatggtggtaaagcgggtgctggagcggcgcctggtcggtgatactgatattggaaaagaactgaaggagcaggtggcagatctggaaaggctgcttgcggcatatcgaagtggtgaaattatcgaaaaaatatgagaaacgaggtactgcccggaatccattttccgggcagtctgcgcatatagaaatattaagacagaaaggcttggaaataacatggaaaaatatgcagggcagggattttcaattcctgataatgtagaggtgacggaacctctgaaaatctatttgaaagagattgggagcattcctcctctcagtgccggtgaagagctcgaactggggaaaagaatcgcggcaggggacacagacgcgaaacggaagctggaggaggcgaatctctgtctggtcgtgtcagccgccgggcagtacagcgggcgcggcctgcagtttttggatctgatccaggaaggcagtattgggctgatgcaggctgtagaaatgtttgattatacaagggacggcacattttccgattatgcacgcagctttattgaggaggccataaaacgtgcagtcgatgaacagtccagggaaatccgtgtgccggcttatgttgcagagaatatgaaaaaggtacagaaaatctcaaatgaactgcggcaggaactggggcgtgcggctacggcaggcgagattgcgggaaggattggggataagacagaagaggaagtgaaaagcgtgctggcatttcttgaaaatccggtttcactggaggctcacacagaggaggaagaggatgatattctggaagatcatatcgaggatcaagaagaaaagactccggaagatgcggtgaatcttttaattcaaaaagaagaagtgcatcatctcctggagaatctgagcgaaagggaacgtcatgtaatcagcatgcgttttggtctggaggatggcagggtccatacccaggaagaagttggacgggagctgaatgtgtcaaaagagcggatctgtcagattgaagaacgtgcgatgaaaaaactccgcgaagccgccgaaaaagaatagtatccgaggttcctgttaaaatagaaatttttcccacacataaacattctaaaattgcaaatattactaacacaagattatgaatggaaagggagaaataaaatgaaaagatttaaaaagtttttattattaatgatgtgtgttggagtactttgcggtgtaacagcatgtggtacagataagaacacaaacgatggaaaaacaaatacaactgacgagaagaatatgaacgatgctacaaacggcaaagacaccaaggataataaaggcgatggtgcggtagataacgcagtggatgatgtaacggatgctgtagatgatgctgctgatgatcttacagataacaatggtcctgaaaaggataatctggaagacagaaatacgaacaacaaagatgtaaataataacgatgcagctaacaacacagataacaatgctgcaaacaatcagtaggataacaccgcagaatctgcgaaggggtctgacccctatgcgccccattttcttaattgtttcaaacaattaagaattcgaggttcataggggtcagacccctagttttttcaactttactgtggtaaaatagcacaatgagacatttcataagttaagatatcattcgaatacgtaaagaaacaaaagtaaaggagtacatattatgagtatggaaagaaagcttgttatgggcaacgaagcgattgccctgggtgctgtccgtgccggtgtgagaatggtggccggttatccggggacgccgtcgacagagattctggagacagttgcaaagtataatgacgggagcattcacgtggagtggtctaccaatgagaaggccgctatggaagtcggtgcaggagctgcttatgccggcgccagaacgctggttacgatgaaacaggtggggctgaatgtggcttccgaccctctgatgagtcttgcctatgttggggtaaaaggcggtatggtgattgtgtcggcggatgatccgggaccgatttcttcacagacggaacaggatacaagacattttgcacaattctcgaagctgcctgtgtttgatccatcatcaccggatgaggcatatctgatgattgcggatgcttttgagtattcggaaaagtaccagacgccggtgcttttccgcccgacgacaagagtgtgtcacgcctgtgtgagcattgatctgctgccaaagctggatgtgcctgagccggaagggttcatcaaggataccatgcgctgggtaattttccccaggctttcctaccagaatcatatcaagatagaagcgagaaatgtggaactgtcggaagtcttttcttcctacgacaagaacctgcgaagggaaggaaaaggcaggaaaggcgttgtctctggcggggtaagttttgcgtatacgagcgaagtgataccggaggatgcgccgcttttgaagatcagcacgcctcatccgtttccggagcgtctggcgaaagaatttatggaggacctggatgaagtgctggtactggaagaactggatccggtgattgaaaaggaactgcttcagattgtgggtaaataccatctgaatgtaaagatttgtggaaaacttacgcatgatacgaagaatgcgggggaaaacagtgtggaaagcattaggggggatctggagcattttcttggggccgaagaaattgattcaaaagagcagggcagtgcacggggggatataccgcagctgccggtcaggcctccggttctgtgtgccgggtgtccccacagagcttccttctatgcagtgaagaaggcaatgcgcgggaaaaaggcggtattcagcggggatatcggctgttataccctgggaaacgcgaagccgctggatatggtggatacctgcctctgtatgggggcagatgtaacgatcgcccagggattacatattatagaacccgacgcggtgaactttgcgttcatcggagattccacatttttcgcttccggtattaccggagttgtgaatgctgtttacaatcagacggacattgtgctgattgtgctggataattctacaacggcgatgaccggccaccagcctcatcctggaacaggtgtaaccatgatgggggaggttgcggccaaaatcagtatcgagaatattttgcggggaatcgggttaacgtggattgaaaccgttgatccgctgaacctggagcttgctgcagacacggtgaagagggcagccaaagaaaagggggtgcgtgccgtgatcttcaagtctccgtgcattgcggtagcaaaaccgggaacgttatatgaggtaaagcaggagtcctgtacaaagtgcaaggtctgcatcagccagctgggatgcccggcaattacagtaaatggcggtgaaattgtggtggagccgtctctgtgttatggatgcggcctttgcagccaggtatgtccgtcaggagcaatcggggaggtggaaagcgatgaataaaagttgtctgttatgtggagtcggaggacagggcgttgtgcttgcctctaaactaattgcctatgcggctatggagcagggaaaatttgtgagaacgacggagaccatcgggatggcacagcgcggaggctctgttgtgagccatgtgcggatggggacagaggtgcattctccgttgattccgctgaaatgtgcggatatgctgctggcatttgaaccggcagaggcggtgcgctgtctgccgtatttaaaagtgggcggtacagtgatcgtcagcagcaaggcggtaaaaccggttacggccacgctgagcggcagtacatatgaaggaaccgagatgctggattatctgaaaaaaaatgtagagaaccttgccatattggacggagaagagatctgcagccaggcgggttcttccagggttttgaatgtagcgctgctgggcgcggcggctgccagcggcgtgctggacatttccgcagaagagatggaaagtgccgtggccgtcaacgtgaaggaaaaatttctggatatgaacaggaaagcattaacacttggaatgaccgcgtttgaaaaggcatagaggggagcagatatgaaaatgacagaattacagctggagctgattaaagaaaatctgaaacagctgacatccaaagattgtttttacaaagaaaagtttcaggatatcgacgtttcaaaaatacagagtcaggaagactttgaaaagctgccgtttacctggaagggagatctacgggaggcatatccgctggggctgcaggccgtgcccgatgaagaggtagtgagaattcattcgtcttcagggacaacggggactccggttattatcccttataccaaaaaggatgtgaaagactgggcgaagatgtttgcccgctgttacgagatggccggaatcacggcgctggacagaattcagattactcccggatacggactgtggaccgccggtatcggatttcaggcaggcgccgagtatttaggtgcaatgacgattccgatgggaccaggtaatacggataaacagctccgcatgatgaaggatatgaaagccaccgttttgtgtgcgacttcttcttatgcactgcttttggcggaggagattgcaaaaaggggtatttctgacaagatacatctgaaaaagggcgtgatcggttccgagcggtggggtgaaaagatgagaaaacggatcgcctcggagctgggggttcagttgtatgatatctatgggctgacggaagtgtatgggccgggaattgccatgagctgtgattatgaatgcggaatgcattattgggatgactatctgtattttgagattgtggatccaaagacaggggaaactgtacccgacggtgaaatcggcgagctggcgattacaaccctgcgcaaacagggcgcaccgcttgtccgataccgtacccatgacctgacgcgttttataccgggtgagtgcaggtgcggttcaaagttcccgcggatcgatacactgatcggaagaacggatgatatggtaaaggtaaaaggcgtcaatatcttcccgagccagattgaagaaatgctgggcggagtaccggaggcttccagcgagtaccagtttatgctggaccatatgaatggaaaagatgtctgcaccctgtttgtggaagtgaacaagaatgtggataaaaagcaggcggaagaagctgtgaaaaaggcgtttaagacgaaaatcggtattactgtgaatgtgatgccggtatcaatcggagatctgccgagaagcgagaaaaaatctacacgtatatttgataaccgatattgataaatgtttgacaatgaggttcaagggggtcagacccctctgcagaggggtctgacccccttgaacaagaaaggaagaagatgaaattcagaccatgtattgacatccataatggaaaggtgaaacagatcgtaggaggcagcctgcgggatcagggggaccaggcggttaccaattttgattcggagctggacgctgaatggtatgctggactttatcggcgggacggtctcaagggaggccacatcatccttctgaaccctgcagcttcggaatattatgaagctacaaaaaaacaggctttgctcgctctcgccgcataccccggagggatgcagatcggcggtggaatccatgcaggtaatgcggcggagtacctggaagcgggagccagccatgtaattgtgacttcttacgtttttcaggacggagtgttccatggggaaaatctgaaacgcctggtgtccgctgtcggaaggaaacatatcgtactggatctgagctgcaggaagagaggcggggcatattacattgtaacaaaccgctggcagacctttaccgatgtccgccttacgcctgaggtactggacaagctttctgcatcctgtgatgaattccttgtgcacggtgtcgatgtggagggaaaatcttccggtgtggagacggagcttgtgtatatgttaagtgggtggaataaaatccccgtcacatatgcaggcggtattggcagcatggaagatctggacgcctttgcttccgtgagcgggaaaaaactggattttacaattggcagtgcgctggatttattcggaggaaacattccctatgagattattgcaaagctgtaaatgaattattaacaagtaatgaatttgttgaattcactggaagatagtgttagaatggagcgtagagtaaatttagacaaggagtaaattacagattatgggttttatagagaagattttcggaacacacagcgaaaatgaattaaagcgtatttacccaatcgtggatcggatcgattcgttggaaccagagtttcaggctctttccgacgcagaattaaaagacaagacaagagaattcaaaaggcggcttgccgatggggagaccttggatgatatccttcccgaagcatatgcaaccgttcgggaagcggcaaagagaagtctgggaatgcgccattaccgcgtccagctgatcggcggaattatccttcatcagggacgtatctcggagatgaagaccggtgaaggtaagaccctggtttcaacacttcctgcatatctgaacgcgctggaaggaaagggcgtgcagattgtaacagtcaatgactatcttgcaaagcgtgatgccgagtggatgggaaaggttcatgaattcctgggactgaccgtaggggtagtcttgaactctatggataatgatgagcgccgtgcagcatacagctgtgacatcacatatgttaccaataacgagctgggctttgactatctgagagataacatggtcatttataaggagcagcttgtacagagaggactgaactacgccatcatcgatgaggtcgattccgttttgatcgacgaggccaggactcctttgattatttccggccagagcgacaagtctacaaagttgtatgaggcctgcgatattctggcgcgtcagctggaacggggcgaggccagcggcgaattctccaagatgaacgccatcatgggggaagacatcgaggagacgggagactttatcgttaatgagaaggaaaaggcagtcaacctgaccgaagacggtgtgaagaaagtagagaagttcttccatatcgaaaacctggcggatgccgaaaacctggagatccagcacaatatcattctggcactgcgcgcacacaatctgatgttccgcgatcaggattatgtagtgactccggagggggaggttgtgatcgtcgatgagtttaccggacgtatcatgccgggacgccgctattcggacggcctgcatcaggcaatagaagcgaaagaacacgtaaaggtaaggcgtgagagtaagacacttgcgaccattacattccagaatctgttcaacaaatacgagaaaaagagcgggatgacaggtacggccctcacagaagaaaaagagttccgtgatatttacggaatggacgtgatcgagataccgaccaatgagccggtacagagaatggatctggaggacgcggtatataagactcaaaaagaaaagttcaaagcggttgtggaagaagtcgagaaagctcacgcgaaggggcagccggtactggtcggcaccataaccatcgagatctccgagctgctgagcaagatgctgaaaaaagcgggcatcccgcataaagttctgaatgccaaatatcatgaaatggaggccgagatcgtagcggatgccggtatacacggcgcggtaacgattgccaccaacatggcgggccgtggtacagatattaagctggatgacgaggcaaaggccgcgggcggactgaagatcatcggtacggaacgccacgagtccagacgaatagataaccagctgcgcggacgttccggacgtcagggagacccgggggagtcccgtttctatatttccctggaagacgacctgatgcgcctgttcggttctgaaaagctgatgagcgtgttcagcacacttggagtagaggacggagagcagatcgaacacaagatgctttccagtgcgattgagaaggcgcagaagaagatcgagagcaacaactttggtatccgtaagaatctgctggaatacgatcaggtcatgaacgagcagagagagattatttacagcgagagacgccgtgtgctggacggcgagagtatgagggatacgatttacagcatgatcacggaatacgtggagaatacagtggaccgtttcgtgtcatcggaagtagatgctgaagagtgggatcttactggtctggatgtgactctgcatgcggtcatcccacagctgaaactgccttcggtgaaagaggcgcaggagatgcagcagaaggagctgaaacaccttctgaaggaacgcgccgtaaaagcttatgaggcaaaagaggcagaatttccggaggcagagcatctgcgtgaggtagagcgtgtcgtattgctgaaagtcattgacggcagatggatggatcatatcgacgatatggatcagcttcgtcagggaatcgggcttcaggcatacggtcagagagacccgcttgtcgagtacaagatgatgggatatgatatgttcggcgagatgaccaactccatcgccgagacaaccatccgcaccctgttccacctccgtattgaacagaaggtggaaagagaacaggtggcaaaggtgaccagtaccaataaggacgagagtgcggtccgcgcaccgaaaaagcgggaagagaagaagatttatccaaacgacccgtgtccgtgcggaagcggaaagaagtacaaacagtgctgcggaagaagataataaaaatcaataacagttcacacaggtctgaactgttacaaaaatcaaacaaaagtgcagaataaatgactgcactgcatatgagaatctgtcatggcagattctcatttaaatgagaaagaggtgaataaggtggttttgttagacgaattaaaagcaaggcttactgcatacgaagaaccgctgaaagatctgagggattcactttgacttagcgtcaaagaaagagcggattgaagagttagaaagaaagatagaagaacccggtttctgggatgagccggaaaagtcgcggcatacgatgcagcatctcaaggctctccaggagtctgtcaagcagatcgagcagctttacggggatcatgaggatatcggtctcctgatcgagatgagcgaagaggatccggacgaggagaccataaaggggattgaggaagaactggcccgtttcgaagaagaatttgaggcgctgcggatccagacacttctgacaggggaatacgacagcagtaatgcgattgttaccctgcatgccggcgcgggcgggacggaatcctgcgactgggccagcatgctgtaccggatgtacagccgttgggcagagaaaaagggcttttcactggaagtgctggattatctggacggcgatgtggccgggataaagggcgtaacttttgaggtggaaggagagaacgcatacggatatctgcgctccgaaaagggcgtgcaccgtctggtcagaatctctccgtttaatgctgccggtaaacggcagacatcgttcgcatcctgcgatgtgatcccggatattgaggatgacattgacattgagatcaatgaggaagacctgcggatcgatacgtaccgttccggcggtgcaggggggcagcacgtcaataagacatcctctgctgtccgcatcacgcatcagcctactgggattgttgttcagtgccagaacgaacgttcccagcatatgaacaaagacaaggcaatgcagatgctcaaggcaaagctgtatctgctcaaacagcaggagcaggcggataaagtgtcaggaatccggggcgaagttaaagagatcggcttcggaagccagatcaggtcttatgtcatgcagccttatacgatggtgaaggatcatcgtacgaatatggagatcagtaatgtgaacggggtcatggatggaaacctggacccgtttattaacgcatatctgagtataaaaccataacaaaaggaaaagggaaaaaggaaaaaggaggaaaacatggtaaatatagcggtaatgggatacggtacagtgggttcgggagtcgtagaggtcatcaatacaaacgggaagcggatcaatcagagagtcggtgatgagatcaacatcaaatatgttctggatctcagagattttccgggagatccgatccaggaaaaactggttcacgattttgacgtaattgtaaatgatcctgacgtgcagatcgtggtggaggttatgggcggtatcgagccggcttatactttcgtcaagcgctgcctgcaggctgggaaaagtgtagcgacctctaacaaggctctggtggcaaaacatggggcagaacttctctccattgcaagagacaacaatatcaactttttgtttgaagccagcgtcggaggaggcatcccgattatccgtcccctgaattcatccatgacggccgatgagatcgaagagatcacaggaatcctcaacggaacaacgaactatatgctgagcaaaatgttctatgagggggctgactacgatgaagttctgaaagaagcccaggcaaacgggtatgcggagcgcaacccggaggcggatgtggaaggctacgatgcctgcaggaaaattgcgatcctgtcctccctgatttcagggcagcaggtagattttgaagatatctataccgaaggtattaccaatatcactaaagaagatatgatgtatgcgaaagcactcggcatgactataaagcttctcgcttccagcaaaagagacggcgataatctgcatgcgattgttgctccttacatgctccacaaggagcacccgctctataatgtaaatgatgtgttcaatgccatctttgtccatggcaatgtgcttggcgacgccatgttctatggcagcggagccggaaaactgccgacagccagtgcggttgtttccgatgtagtggatgaggcgaagcatctgaaccggaatatcatgaccatgtggaagagtgaaaagttaagccttcagccgatctcggcaaccagtaaaaagtattttgtaagaatccagggggatgccgatgcaatgaaggcgcatctggagagcaagtttggcccaatcgagattgtgaaggcagagggcctgaaaaacgaattcggtttcgttacaggtgtgatgacagaaggtgcttatgaagaaaatgcgaaagaatttccaagcattctgcatatgatacgtgtagaaggttaagataaagacctgaaaataaactggaggcataacatgaaatatgtaattgtactgtgtgacggagctgcagatgaaccgctggaggaactgggcggcagaaccccgctgcaggcagctgagactcccaacacagataaactggcgcccaaatcagagatcggcatggtccgcaccgtgcctgcagggatggcgcccgggagcgatacggcgaatctgtccgtgatcggatatgacccaaaagagtattataccggaagatccccgttagaagcgttgagcatcggagtggatatggaaccttctgacgttgctttccgctgcaatattgtgacattgacggaggcgcaggactgctatgaagacagagtgattgtggatcacagctccgatgaaatcagcacagaggacgcgtccgtactcattgaggcactgaaggaaggactggagcgggaagactacgagttctacgtgggaaccagctacagacatcttctgattcggaaagagggcagggtagtggagctgaccgctccccatgatattctgaccaggagaatcggggactatctgcccgccgatcctatcctgcgtgaaatgatggaaaaaagttatgacatactatccgtccatccactgaatgttgagagaaaaaggcaggggaagaacccggccaattccgcttggttctggggagcaggcacaaggcctatgctgacctcctttgaagaaaagttcggaaagaaaggcgccatgatctctgcggtggatctgctgaaaggcattgccacaggggccgggatgcacaatatttcagtggacggagccaatggcggtttacataccaattatgccggaaaagcaaaggcagctgtgaaagctctgacacaggaggggtatgattttgcctacatccatgtggaggcgccagatgagatggggcatcagggcagttttaaaaataaaataacggccattgagaatatcgatgcccatatcatcggcccggcggcggagatgctggaagcggcagggaaagagttccgcatgctgatacttccggatcatccgacaccggtaagcgtgcgcactcatacaggagatcctgtgccatacctgctatatgacagcagaaatgcggtgcagggtttggcttcctacgacgaggagagtgctcgcagcagcggaataagggaagaagtgggacacacattgatttcccgtctttttgagcagaaataatgcacagccggtcagaaatcaggaggacaacatgctgatagttaaaaaatttgggggaagttcagttgcggacagggaatgtcttttccgcgtggctgagcgctgtatcgaagaatacagaaaaggaaacgacgtgatcgttgtcttgtctgcaatgggggacacaacggacgaactcatagaaaaagcgaagttaatcactgcagaaccgtcgaaaagagagatggatatgctgcttacaacaggagagcaggtctcggcatctctactggctatggccatcaactcgctgggagtgccggccgtctcactgaatgcattccaggtcaggatgcactgcacatctgcctacggcaatgccaggtttaaacgggtagaatccgaaagaatacgccacgaactggattccagaaaaatagtggttgtcacaggctttcagggcgtgaataaatacgaggattatgcaacacttggcagaggcggttcagataccaccgcagtagccattgcggctgcacttcatgcggatgcctgcgagatctatacggatgtggacggcgtatacactgcggatccgcggatcgtgccgaatgcgaggaaactggatgccatcagttatgatgagatgctggaactcgcgtcactgggggcgagagtgctccacaaccgttccgtggagatggcaaaaaaatacggtgtacagctggtcgtacgttccagtctgaacagaaatgaaggaacggtagtcaaggaggtagtgaaattggagaaaatgttaatcagcggagttgcttccgacaaaaacacatccagagtttccgtgatcggtgtagacgataagcccggcgtggcatttaaaatattcaacacactggcaaggaaggggatcaatgtggacatcattttgcagtcagtaggacgagagggaacaaaagacatctcctttaccgttgcgcaggacgatttggaagaaacgctcaggattctgaatgaaaataaagaggagctgacaatccaggcaatcgaacacaaagacaatgtagccaaaatctccatcgtcggtgcgggcatgatgagcaatccgggtgtggcagcaaaaatgtttgaggcactgttcaatgcgggcgtaaatatcaacatgatatccacgtccgaagtgcggatcactgtgttgattgaagaaaacgatgtagaaagagccatgatagcagtacacgacagattcgggctggcggagtaatggattgaggggcactttcctgaccaggaagaagtcgggcccgtatgtgtgcggtactgcgcgggaggacggatgagggcatttaggcggcggtaagcgccccttcatcaaaaagagcattgaaatatggaccgtctgcagggttacaagccctgcaggcgagctgacctgcagggtgaatgcatcggcattcacgcgaatgtcagcggtgtccaatatttcaatgctctttttgattaggggcgcttaccgccgccggcagctctcagctaggccatattcccatttcctccggcgtccgcataccctctactattcaacgagtagccttttgactactgcttttacgtcttcacctgcattccgaacgcccatgacaattgcaacctcttcttctgaaagatatatggtgtcaccggtcaggagttctattcctggttgaaatggtcctttatcctcctggattatgccgtctgccctgtagggatgtttaatcagatcgtccagtgttatgttataaatctgtgcaattttaaggagcaggtctaaatccggcgttcttttgccggtttcgtagtttgaatatgcctgccgggagatgttcagcgctctaccaagttctttttgagtcattctgcgggcctttctgtaacgccccaagttttcaaccagttgtatattggccaatgtgacacctccattcacaggaaaattgaaatcttcataaattatagcaatttttcctgcaaatagatatttttgccacgaaacgtatattcgatgtaaaaagcaacttttcgttgccatctgttttatcggcttaatatgctgttgtggtacctggaggagaaggtgacatcttccccgaaccaggatggcgcctggaaggagacggcggtttcctcatctggaaattcaacttcagccagaatcagcggctccagatcgccgtgaaaaagatccagctcaatagtaagtccgttgtccagcggcagcatatagcgtgtcttctggatcagccgtccgtcaatttttgctttcaggtgctgataggcctctgacgtcagggggaggttgtattcctcgcgtaccatcagccctcttgatttataggtgagtacgtagtcttcgttgtctctccggatgcgcaccacgggttctgtacagagatagccctgctcgatctgccggcttggatactcttccaggcggcagggaatgttgtctttatcgatcagatatttgcgttcgatttccataaagtgctccttatcatttttttattatcataatactgcgtgtaaaaattgtaaaccattgcatttccagacttcatttgatacactgaaattgcgctgaaaatgcagacagtaaagtgtaatttgaaggaggaatcagtgatgaaggatgtaaaagtatttctggcggacggctttgaagaaatcgaaggactcaccgttgtggatctgctccgaagggcgggggctgccgtcgatacagtatccgtaaccggatgttctgtgatcagcggtgcccatggaatcaaggtggaggcagatattctgtttgaagaggcagacttttccgggacagatatgctggtactgccgggaggcatgccgggtacagtgcatctccaggagcatccggggctgaacgggcttctcagggacttttacggcagggaaaaatatattgcggcaatctgtgcggcgccgagtattctgggaggacttggatttctgaaaggacgcagggcatgttcctacccctcaaaagagaaggaactgaccggtgcggaagtggtacggacacctgtggcagtggatggaaacatcataacgagccgtggaatgggtactgccataccattttccctggaattgatttccttactgtgcggggctgaaaagtcagacgaagtcagagcgtcaatcatatttgggtaaaaagtatccaaaaggcttaaaaaaccccgaaaaataaggaataacaagtaaaaagtactggaaatttactgacgaatgtgctatactcctttaatgactgtgaatgtatattatcaggtacggaaccgcctgactgatacaaaactgcatgacgaatggtacgaatcaaggaggaagataaaaaatgagtttacaggtagaaaagttagaacataatatggcgaaacttacaatcgaagttccggccgaggaagtggagcaggctctccaggcatcatacttaaaacagcgcaatcagattagtatgcctggtttccgcaaaggaaaagtgccgagacagatggttgagaagatgtacggaccggaagtgttctatgatgatgcggcaaacaagcttgttcaggaagcctacgcaaaagcttttgatgagtgcgagctggagcttgtgacaccgccggatatcgatgttgtacagctggaaaagggaaagccgtttatctttactgcagaagttgcagtaaagccggaagtgacccttggcgaatataaaggattaaaggtagataagatatccaccagagttaccgcaaaagaaatcgatgaagagatcgacaaagagcgcgagcgcaatgcgagaactgtcgatgtgacagaccgcgcagtggaggataacgaccagatcacactggattttgaaggatttgttgacggagtggcattcccaggcggaaaagcacaggattatccgctggttatcggatccggatcattcatcccgggattcgaggagcagttgatcggcgctgagatcggcaaagagatggaagtcaatgtgacattcccggaggaatatcagtcagcagaacttgctggaaaagatgctgtatttaaatgtacagtgcatgcaatcaaggcaaaggagcttccggaactggacgatgagtttgcttctgaagtatccgagtgtgagacactggaagactataaggcagaagtaaagaaaaagatcaaagagcgcaaagaacgcgaaggaaaagaaaagaaagagaatcaggtaattgatatggctgcagagaatgcgcaggtagacattccagaagcgatgatccagatgaagatgagagagatcttaggggaattagaacagcgcatccagcagcagggcctgagcatggagcagtaccttcagtttacgggtgtgtcaaaagagggtatgcttgcggagttaaggccggaggcagagaagcgtattaagacgaaactggttatggaagcaatcgtaaaagctgagaatcttgagacatccgaggaacgtctgcaggaagaactgcagaagatggcggatgcttatgagatggaagttgagaaactcagaggcttcatgggagagaatgaaaagaagcagatggaggatggccttgccgtacaggaagccattaaactgctggtagcttctgctgtggaagagtaaatgaatgggctttatgactgagcagagataacccggtgactagcccggcacctgtcgggcagtccgtattcaaaaattattaggagggacatcaatgagtttagtaccttatgtcattgagcagacgagccgtggagaacgttcctacgacatatactcaagattattaaaagaaagaatcattttccttggagaagaggtaaatgatgtgtcggcaagcgtaattgttgcagagcttctttttttggaagcggaggatccggataaggatatccagctgtacatcaacagtcctggtggttctgtaacctcaggaatggcaatctacgacaccatgcagtacatcaagtgcgacgtttctaccgtgtgtatcggtatggcggcaagcatgggggcatttttgctgtcaggcggcaagaagggcaaacgctttgcgcttcctaacgccgagattatgattcatcagccgtcaggcggagcacaggggcaggcaactgagattcagattgtagcagagcatattctgaagacacgccagaagttgaaccagatactggccgagaacaccggacagagcctggacgtgatcaaggtcgatacagagagggacaattatatgtcggctctggaggctaaggagtatggattaatagatgaggtaattgccagtcattaagggcaatatgaggtgaaaagcattatggcaggaaaagtaagcgatgatacagtgagatgttctttctgtaataagacgcaggcgcaggtgcgtaagctgatcgcaggtccgaacggagcatatatctgtgatgagtgcattgacgtgtgtgccgagattattgaggaagaattcgagtacgatgagataagagcgtttgatgatattaatcttctgaagccggaggaaataaagacatttctggacgagtacgtaatcggacaggatgaagcaaagaaagtcctttcagtagctgtatataatcattacaagcggattatggcagagcaggatttaggagtggagctgcaaaagagtaatatactgatgcttgggccgactggctgcggtaaaacgctgcttgctcagactcttgcgaagattctgaatgtaccatttgctattgcagatgccacggcattaactgaggccggttatgtgggagaggatgtagagaatatcctcctgaaggtgattcaggccgcggatggagacattgcccgcgcagagcacggcatcatctatatcgatgagatcgataaaattacaagaaaatctgaaaatccgtccatcacacgtgacgtatccggtgagggagtacagcaggcactcttgaagattatcgagggtactgttgcatcggttcccccccagggggggagaaaacatccccatcaggaattgatacagattgacacgacaaacatcctgtttatctgcggcggagcgtttgaggggatcgataagatgattgagacccgtatcgataagaagtcgattggattcaatgcggagattgcatccaagcatgaatacaatgtcgatgtgctgctgcatcaggtattgccgcaggatctggtaaagtttggacttataccggagcttgtcggacgtctgcctgtgacggtgaccttggatatgctggatgaagaggccctgatcaggatactgacagagccgaagagtgcaattgtgaagcagtatcagaagctgctggaattagacggcgttaggcttgactttgatgaggatgccctctacgcaatcgcagagacatcttttgcaagaaagacaggagccagaggccttagggcgatcatggaagatattatgatggacaccatgtttaaggtgccgtctgatgatacgatcaaaggatgccgtatcacaaaagaagtggtgaaagggacgggaaaaccattgtatgaatgcgatggtgaagaacgcagatcgttcctggcatcggagagtgcataagaaagacaggcgggtgcagtggtataccatgtatccgccttttcacatgcacataaaaagccggtaaggcagtttagtgggtggaggagataatatgaaaagtgagaaacagagccttccgatggttgcgctgcgtggtatgactatcatgccggagatggtggtgcattttgatgtaagccgccagcgttcaatagcggcgatccaggaggctatggtagaagatcagaagattttcatgataacgcagaaagatctggagactgagaatccaaagcaggaggatctttatgaagtaggaaccgtaggaacgatcaaacaaattattaagctgccgaagcatatcatgcgggtactcgtttccggggagacgagaggcgtcctgcagaagattgaatacgaggatccctatctgcgcgcggaagtggatgttatggacgaatccgatgtgctgattagagatgatttgaatgcacaggccatggagcgcggccttaaagatatgtttgtggactttgcggcaaagagcgggaagatgtccaaagaatcagtggctcaggttctggagattaaggggctgaaaaagctggtcgatgagatcgcggccaatactccgctgttctatacagatcttcaggagattctgaatgaaacggatttttggaagcgttacgaggcactggcctttaaattggtgaatgaaatacagattatgaatctgaaagaagagatccagatgaaagtaaaggagagggtggataaacaccagagagaatatattctccgggaacagttaaaactaatccgggaggaactgggtgacgatacaaccctctcggatgctgaggagtttgaaaaagcggcgaaggggctgaaggctcccaaggaagtgaaagagaagctggctaaggaaatcagccgttttaaaagttccctgaacagtcctgcagaaagcggcgtcatcaggacctacatcgagacgctgctggaaatgccgtggaataagtcggtgaaagacagcggagatatcgaattcgcccggaaagtgctggatgaggatcactacggtctggagcaggtaaaggagagagtgctggagtttctggccgtgcgttccctgaccaaaaagggagaaagtccgattctgtgtctggtgggcccgccgggaaccggtaagacctcgattgccaagtcccttgcaagggcgctgaaaaagccttatgtcagaatttccctgggcggtgtgcgggatgaagccgagatccgcggccatagaaagacatatgtgggagctatgccaggcagaatcgcgaatgggatgaagagcgcaggcgtgaaaaatccggttatgctgcttgacgagatcgacaaagtaagcaccgattataagggcgatacattttctgctctcttggaagtactggacagcgagcaaaacagcaagttcagggatcattatctggaggtgccgatggacctgtcagaagtgctgtttattacgacggcaaatacactgcagaccataccgaggccgcttctggatcgtatggaagtgattgaagtgagcagctacacggagaacgagaagctccacattgccatagagcatctgattccaaaacagctggagaagcatggattgaaagaggagcagctgactttcagtaagcatgcgatctggaagatggcacgcaactatactaaggaagccggtgtcagacagctggagagggagatcgggaatatctgcagaaaggctgctaaggaaatactgacagtaaacaagaataagatcacgataacagagaagaatattcataaatatctcggaaaagaaaaatatacgtatcagatggcaaatgtttcggacgagatcggtattgtacgcggcctggcttggacaagtgtgggtggtgacacgcttcagattgaagtgaacgtcatgccgggaaatggcgagattatgctgacagggcagctgggtgacgtgatgaaggaatcggcgcgaacagggatcagctatattcgttccatcagcaggcggtatcagattgcggaggattttttcgaaaagcacgatatccatgtacacattccagagggggcggttccaaaagacggcccttccgcaggaattactatggcaacggctatgctttctgccattacggaacagaaagtccgggcagatctggccatgaccggcgaagtgacgctgcgcggccgggtgcttccgattggaggactgaaggagaaactgcttgcggcgaaaaacgcggggataaagacggtgctgattccaaaagaaaataaaatagatgtggatggcctttccaccgaaatcacgaagggcctggagatcctgccggttgaaagtatggatgaggtactgaaggcggccctgaccggggagacgagcggggataagccacagacaggagtatagaatggtaatcaaaaacattaatttggagacagtctgcgggatcacaagcgtgcttccggacaatgacaagccggagatcgcgttcgcagggaaatctaatgtaggaaaatcttcgctgatcaatgcgctgatgaaccgaaaatcctatgcgagaatatccgctacaccgggtaaaacacagacgattaatttttataatatcaacgaagagatgtatctcgtagacctgccgggctatggctatgcaaaagtctcagaaaaggaaaaggtacagtggggaaagctgattgagcgttatctgaatggatccacccagctgaaggccatttttctgctgattgatatccggcatgagccttctgctaacgataagatgatgtacagctggattgtggaacagggattccagccgatcatcattgccacaaagctggataaactaaagagaagccagattcagaagcatgtgaaaatggtaagagagggccttgatctggttccagggacgaagattattccgttctcctcaaccacaaaacagggcagagatgagatttgggagctcatagaaagcgagtatttagacagagcagaggtggagtagatatggagaacagacggccgtactggcaggtggctgtaagccttgtttttagtcttgcggcgacagcggcttttgtgtttattggaataaaatcaatcggattttttatgccgtttgtcatcggctggataatatcggcgattgccacgcccgtagtgaactggctggagaaaagattgaagattgtgaaaaagctgggttcggccctgattgtaattgtagtgctggcattgatcgtactgcttatttactttgccgtcagcaaagtatctgcggagatcggggatctgattaaaaattttccggatctttacgcccagctggaagtaggcctgcgcgagatcgggagcacactgtcgggagtattctcgaagctaccggcgggtatacaaaacggttggaatgctgttgttgcaaacctggatcagtcgatgggcgagctggtgagtaagatcagccagccgacggtaactgcagcgggcaactttgcaaagagtctgccgtcctatctgatatcctttattgtggcgatgatgtcggcctacttttttacggttcagagagaagaagtgatcctatggctgaaaaaggtttcccctccatcggtagaaaagcggatgagccttgtcatggacaatctgaaatatgcggtgggcggatatttcaaggcgcagttcaagatcatgggaattgtatttcttatcctgtttgcaggactggggatgttcggcgtacattacgccatcttgattgcgtttctgatcgcattcctggacttcctgcccttttttggtacgggtacagccatgataccgtgggccttgtataagctcctaacgggggattacaagatgacggcggcgctgcttgtaatctatgtgatcacccagctggtgcgccagcttctgcagccgaaactggtaggggacagcatgggactgaacccgcttgtgacgctgctgctgctttatattggatacaaggtgagcagcgtactggggctgatcctggcagtgccgatcggaatggtactgataaacatgtgccaggcaggggcctttgattatatattcgatgatgtaaagatactcgtggagggggtgctggggctgcgggagtagggggcgttatgttcgcctgccagcggttctggtatcaggcacacacttctcctgtgcctgataccagaaccgctggcaggctgggcgcatccggtaaggagatgcggcggatcaggaggtggtttaaacggatgatggttaagactgattttatgttctcggagagaattgggtgttttgagtggagatttttattagtggggttacggatatggctccggagatgtctatgttttctacttccggagggtaggtcaggctgaaggataggcgggcttcttcggtggcagctgcgttggtggtgaagcttccggcggcggaggtgttgcgggagccgctgcctgcgggggcaaggaaggcatagagcagctgcagggttccgttaattctgggaacgatctgcatgtaattgtctggctctgtggtggcaagaagcagatagttaattaggtatagatagccgggggccagaatgatttcggtgtttccgttcaggtgtatctgagtgccctcctggaaaatggggatcataggcaggtttgaacctgacggcggactagcctgtacgccgtactgggcataaaaatcgattcttcccttgggcggttcaggcggacatggtggaattggcggtggacaacaatttggtctcaaattgatacactccttatctttcttatataattagtatattgataagacaggagagtgtgacggggaagcgatggtttacaagccgtatcggcgatttccgctctttttcacgtggtgcaggctgtacatgcagaacatcagccaaatgggcagaatgatgcctttcaggacactggagatactgatactccaccagatcccattcagcttcagtacgctggccgagaggacggctgccagtggaatccgaagtgtgttgaatatgattccggtcagagaaggcggcagtgttctgcccagtccctggaatgctccggcggatgcggcctctgtgcacataaagagctgtgagacagccagaatgcgcaggtagtctgtgcccattgggaggatgtctgtttccgggatgaagacgcggaacaggatttccgggaaaagaagaagcgcaagagtcgtaaaaagaccccaggtgcacatgattttgagtgcgctgaagtagccttttctgacacggtcatttttaccggcgccataattctgcgcggtaaatgcattgactgcactgccaaatccctccgcggtcatccatgagatggattcaatctggctgccgactttctggactgcaacggctgcatcgccccagcctgcgatcattctcgcaatcagcatggagatgccggtgaaaatcaaattctggacggaagcgggaagacccacaagcagaatttccctcatgcgttttacggcaggccgctgcaaaatacggacttttgaaaagatcagagcatccctccggatacgcaggatatagattgagaacaccattacctgtgcaaaaacagtggctgctgcggcaccctttacaccgagacggggcagcggcccagggccgaatatcagaaccgggtcgaggaccaggttgataacaagcccgatcgttgtggaccagaacgtgatcatactatttcccatggccgtcagaagccctgtgaaaatttggttgataaagttaaatacaattcctccacaggtgaccgccagataccagcgggcgtccagaatcacttccgggctgttgaggcggaaaaagccaatcagtggtctattaaatatcacggatatgacgccgtaaagaagtccaaagagcagtcccatctgtagggaagccgtggcatactgcaccgccttttcctttttaccggcgcccagagactgggccgtaagcacctgtccccccatccttgcaagcatggtaattccagcggaaagccagatatacatgccggctgcgccaacggctgcaacggcattactgccaatccgtccgatccagagcatatcggtcagattataggccatctgaatcagcgaagtccccataatgggaagggccagcctggccagagacccggctatcgggccatttaacaagtcaattccttttttcattctatgatttcccctaatgaagcagttaattttaacagttgtagatacagcagtatccatgtgtaattctgaacagttataaacagcggtaatattataacatggaatgatacgatatgacagaggaaaaccaggaatcaaattaccttaccatgaaacagaataagaattgacttcccggtaatctcaggcctataatagtcgtattacaactacatataaagaaaatggaggcgttactatgacaaaggtattaattcagccaggaccatgcggacttgacacacaggtagaagcaacttcagaggacgggatggaggtacaggtaaagattacatctggctgcgaatccatcaataaaatgacagaagaattaggtgatacatgggacgcctacgaagtctgtcttggaaagccgggaaccggccctctctacgattatgcagcagaaaaactgccgggccatgcatcctgtcctgccatagcgggaatcatcaaatgcatcgaagtagaatgtaaactggcactcccaaaagatgcatcaatcacatttgtttagggagtgaggttttaacgaatgaatgggaggacgctgtccggaatcgcggcagtcctctttgggatgcggctttgcggcgtaacagccgctaatcaaaatgaaagccagcattatggacaccgccgacaaacacgggtatgccgatgcatacccgcttgagtcggcttattcgcaggactggaagtcctgcgaatagtccatatgctggctttcattttgatgtagcggctgtaacaccacaaagaagcatcccaaagaggactgccgcgattccagacagctggtgcatccggccggtagaaacatcttccctcctcgggagaagctcagaacgggagctacggatgttgtctgaatgtccggtaagtgtaacatacaataaagtgataatacctaaacctatagatcatatatccgcagacccattcccgtccgccttccccgtctgcggctcctccgggaaggggggcagccgccttgatgcacccagcctgattgaaatgtggaggaggatgccctgttcaccgcattctctcaaaccctattcagcactcctttgatatatttacctgtgtaggattgtggattctcagcgatttcttccggtgttccggttgcgactacggttccgcctttgtcgcccccttccggtcctatatcgatgatgtaatcggcagttttgatgacatccaggttgtgttcgataacgatgacggtgttgccgtctccggagagccgcctcaggatttcggtcagtttgtggacatcggcaaagtggaggccggttgttggttcatccaggatgtagactgtctttcctgtgctgcgtctgctcagttcggacgccagtttgatcctctgggcttcaccgcccgataattcagtggagggctgtcccaggcggatgtaggaaaggcccacatcattgagggtctccatctttctccggatgcttggaacatgctcaaagaactgcagggcctcctctacggtcatattgaggacgtcataaatggtctttcctttgtatttaacttccagagtctcgcggttgtatcgtttgcctccacagacttcgcaggggacgtatacgtccggaaggaaatgcatctcgatctttaggatcccatccccgctgcaggcctcacagcgtccgcccttgacgttgaagctgaaacgcccctttttgtagccgcgcgccttggcgtcgggggttgatgcaaacagatcgcggatcagatcgaagactccggtataagttgcaggattggaacggggagtacgcccgattggggattgatcgatatcgattactttatcgacctgatccaatccttcgatgcgcttgtgtttccccgggattgtccttgcacggttgagttccttggccagttttttgtaaaggatttcgtttacaagagaactcttacccgaaccggaaacacctgtcacacaggtcataattccaagtggaatgtctacatcaatatttttcaggttattctgctgtgcaccgataattctgaggtatccggcaggctgttctctcttttcgggaatcggtattttgatcttgccgctcagataggctccggtgatggagttcttgtttttcatgatttcctgcgcggttccgacggcgatcacttctccgccgtgctcgcctgcgccggggcctatgtccacgatgcagtcggcggccagcatggtgtcctcatcgtgctctacgacaatcagagtgttgcccagatcccggagatgcttcagcgtgccaagaagcttatcgttgtcccgctgatgcagtccgatgcttggctcatccagaatgtaggcgacgcctaccaggccggagccgatctgggtagccaggcggatcctctgggcctccccgccggatagagaggcggttgcccttgccagtgtcaggtaatcgagtcccacatccatcagaaactggatccgggccttgatttccttgagtatctgcccgccgatcagcagctgtgtctcggtgagctgcagttcgtgtaaaaactcctgcagtttattgatggacagagcggtaacggcggcgatattctgaccgccaaccgtaacggccagagccccctttttcagacgctgccctccacattcggagcagggggtgatattcataaaagtttcgtattctgccttcatcgtgtccgaacctgtctcgcgataacggcgttccacattctttagaagtccttcaaaggccacatcgtagacgccttctccgcgctgtcctttataatatacctttacagactttccgtttgttccgtggatcaggatgtcatgcactttctttgaatactgttcgaagggagtatctagatcaaacttatattccttgcagagagcatccagaatcgccctggtaaaactggatttgtccgtacaggactgccagccgatgactgtgatagccccctcgctgatactgagcgacggattggggatgatcaagtcctcagcaaattccatcttatatcccaggccgaagcagaccggacatgcgccgaagggattgttgaaggagaagcttctaggctcaatctcttcaatgctgattccacagtccgggcaggcaaagctctggctgaaattcattgcttctcccccgatgatatcaacagtcagcaggccttctgcaaggctcagtacactttccacggaatctgtcaggcgtttctcgataccgggttttacgacaagacggtccacgataatctcgatgttatgcttaatattcttatccagggtaatttcctcggataattcatacaggtttccgtcgatgcgtacacgcacgtagccgctcctttttgcccgttccaggagcttggtatgggttcccttgcggcccctgactaccggggccataagctggatttttgttccctcgggcaggttcatgacctgatccaccatctggtccacggtctgcttcataatctctttgccgcatttgggacagtgggggataccgatgcgcgcgtagagaagacgaaaatagtcgtagatttccgtaacagttccaactgtagaacgggggttgtgattggttgatttctggtcaatggaaattgcgggagaaagcccttcaatgctctccacattaggtttttccatctggcccagaaattgccttgcgtaagaggagagcgattccatatatctgcgctggccttccgcataaatcgtatcaaatgcaagggaggacttcccggagccgctgagtccggtcagaacgacgagttcatttctgggaatgtccaaatctatattttttaggttgttttcatttgcgccgcgtatcttaatgtactttctggcgtccatttttttgcccatttgttatccttcctgttccttctaaaatgtatttataatgctctgtcagtcgtccatatcgttcaggactttcttgagctccaccagcttatctctcagctcagcagcggactcgaagttcagttctgcggcagcctttttcatctgttttgacaggtctccaattaatttttccagttctttcctgctcatcgattccggatctttttccatccgcaactcctctgcggcaactttcttggaaatactgatcaggtcacgtacagatttacggatcgtctgcggtgtgattccatgctcctcattgtacttcatctgtatttcgcggcggcgctgcgtctcatccatggctgtccgcatggaatctgttatggtatctgcgtacatgatgacatgcccctctgcgttacgcgctgcccggccgatcgtctggatcagagaggtgccggaacgcaggaagccttctttatccgcatccaggatcgccaccagtgtgatctcgggaatatccagcccctccctcagaaggttaatgcccacgagtacatcaaatacatccagacgcatatcccggatgatctccgaacgctccagggtatcgatatcggagtgcaggtatttgacacggatacccacctcgcgcatatagtcggtcaggtcctcggccattctttttgtcagtgtggttaccagaaccttattcttttttgcaacctccttattcacttctccgaccagatcgtcgatctgcccctccaccggacggaccgtgacctcgggatccaacagccctgtggggcggataacctgctctgtccgaagcagttcgtgttcttcctcataaacactcggcgtggcagatacaaataaaacctgattgatcttgctttcaaattcttcaaaattgagcggacggttatcctttgctgagggcagccggaatccgaagtccacgagggttgacttgcgcgactggtcgccggagtacatgccgccgatctggggaatggtcttgtgggactcatctatcatgatgataaaatcatcagggaagtagtcaatcagcgtgtagggcggctgcccgggagcaagcccggccagatggcgggaatagttttcaatgccggaacagaatccggtctcctttagcatctcaatatcaaagtttgtgcgctcggcaatccgctgtgcttccagcagcttatcctggcgcttgaattccttaacgcgctcttccagctctgcctcgatggcggttaccgcgcgggcgatattctccttgtccacaacataatgtgatgcggggaagattgcgatgtgcttcagctcatccttgatctccccggtcaggacgtcaatctcggtaatccgctccacctcatccccgaaccattcgatgcggatcgcggtatcttcggagtaagcagggatcacctccagaacgtcaccccgcacccggaaggtgccgcggtggaaatccatttcatttctgtcatactgtatctcgatgagttttgccatgacttcatctctgtcccgcgtcatgcccgggcgcagtgaaatcaccatgttctggtagtccatcgggcttcccagtccatagatacaggatacgctggctacgatgatcacatcccgccgttccgccagggccatagtggcggacagacggagtttgtcaatctcgtcattgatcgccgaatccttggcaatatatgtgtctgatgagggaacataggcttccggctggtaataatcgtagtagcttacgaaatattcgaccgcattgttgggaaagaattccttaaactcaccgtatagctgtgcggccagagtcttgttgtgggcgatgatcagagtgggcctgttcagcgcctgaatcacgttggccatggtaaatgtcttaccggaaccggtaactccgagcagagtttcaaattgattgccctcttgaaacccacgcaccaactcagcaatggcttggggttggtcgcctgtgggctgatattccgatacaagtttaaaatgatccataaacccgatacctccatatataaacaattccctaaaattgggaatttcatactctcatagtgtcagatatgattatagcagaggatctggaaaatgtacagtggaaatcgaatgtttgttctgtataattccgaggacatgtacccgttctggacggactgaaccggtacgaatccagcccatggaaactcgccttcggtgagggggagaaaacattgcaaagaaggctgtttatggtataatgaatgttagtgggaaaagcgtgcctgcacatttttcaaacggcgaatggtggccatgaatctcagattcataatatcatgatactgattcgatattaaatgggggtcatattttatataaaattatccgtgcatgctattgactggcaatcggaaaatgagcgaaaggacagaagatatgaaaaaaagaatgattgcactgctgatcctttccgcctttatactgtgcgcattatccggatgcaaagagaacagcagagtcgtaaactatgaggggcaggacggagaaactacaaccatcaccttttttgggaataagtatgaaccagaaaatgttatggtcatagaggagattatatccggcttcatgacagagaatcccggtatccgagtttcctatgaaagcctgaaagggtccgaatattttgaagcattaagaaaacggatggcttccggcaagggaaacgatgtatttatggtaaatcacgatatcctgctggagctgcagcataaagggcaggtggcggatctgtcatcgctcagcgtgatcccggagtataccggacagatgcgcagccaaatggaggagaacggagaaatctactgggtacctaccacggtatctgcgtttgggctgtactgcaacatggatttactcaaggaacacgggcaggaggtgcctcagaatctcggagaatgggaagaagtgtgcggctatttcaaaaacagagggattacaccggtgattgccaacaatgatatttctctgaagacattggccattgggtacggattttactctgtctatcaggaagagcggcaggcagaggtatttgctcagattaacagaggtgaagagacgctgagcggttatctgagttccgggttttctatagtggaaagttttatccggaaaggatttattgacggggaaaaggcacttgatacgaagaaaacctccgatgacctggaggagtttatcaagggagaatctccctttatgctgacgggtgcatgggcggccgggcgcgtcagcgcgatgcagccggagttcggctttgaggtacatccgctcccggttttagaggacggttctctgctggtgatcaatccggataccaaactgagcgtaaatgccggcagcgggcatttagatgctgccatgaaatttgtagagtattttaccagggcggaaaatattcagaaattcgcggaccagcagtcttcattcaatccgctgcaagggaaggaccaggcaccggcgcaggagatcctgccgctggtgtcctgttacaaaagcgggcgtacggtgataggtacggacgcattactggatctgccgatctgggagctgactactgaagcatcacagaggctgcttgcgggagaagcgctggatacagtcatggattggatggatctgcaggtggaggaggacaggatgccttgaaaaagaatgaagcaacagaatcgaaaaaatcaaaattgttcattgtgaccgcagcgctcgtcacaggcgttttgctcggcaccataacagtatttttcgtaaggacggtacagcgccagctgtggcagcagtcgatggcttccattatggagagtacccagcagggacgcaacacgctgcagatccagctacgaggggaatacgaagtgatgggaaccgtggcatcgcatttaagggaatatgcaggtacgcaggccgcagaactggacgaatatttaaggaattacagtgaggtggatacaggaatcctcctgtatctggagaatacagcatgttatccggatgatatggggatggacgaaaacttaacggaaatacttgagaagaatgaccagaaacagggaatcattgccccgcatatcagcagtgctactggtgtcaatgtatttaacctgtttgttcaagtgacgctgaaagacggtacaaaaggatatcttatcaaagagtatgaggtggatcggatcgttgacacatttactgtttcgttctatcaggacacaggcttttcctatgtgctggatacaaacggcaatatcctcatccggccgccccatcccaacagtaacaaaaccgtacagaatctttttgatatgctgcaggtacctgaaaacagccagaccgggctggaacgttttacacagtcgctgagggaggggaaaacgggatgggccacctttacctatcaggaggaaaataccgttttctgttatatccctttgaagctggataccgactggtatttggtttccattatcccttctgccgttgtgaataagcagaccagccagattataatgcgtacatttaccttgattggctgcattatcctgggaatagccctgttggtgctgctgtattttcgttatgtaaaccgggcgaaccacaggctccgcaatcaggcggagtatatcagccacctgtataatgctgttcctgagggaattctccttacgacatcggaggagccgtaccggtttctgcaggtcaatgatgaggggctccgccttctgggatttccggaaggatcaccgaacgacaccctggaaggtaagagtcttcgctgtatggcacattcggaggattatgaaagagcggtgcagctgtttcaggatacggcatggaatgggcataagaacgtttttgaaatccggatcagaaaaaagaatgattcttacttttgggcgaccggaattgtggaaaaaactctggatcaaaatggtcatccagtgttcatcattgcctttcacgatattaccgaggaaaagctggcgaaagaagaggctaagcgcagggatctgcaggagcgtttaacactggtgggagcgatctccaatgcgtatcctttgattatcagccttaacctgtcccttgatactctgaagtttgtgtatgtcaggccagggctgatgctctccattggagaacagcagtcttacagcgagctgtatgccgatatggcgccagccgtccatgaagaccatcgggagcattttaagcagcgtttcgcgcccgagcagcttttgggcaccctgggcggggaaagagatgaaatcagtggggaatataaacacctgctggcggatggggagtatcattggatttctactcagatcatagaggtagacaatccctattccgaggataaactggcgatcctgatttcccggaggatcgatgagcagcgatacgaggaggaacggcagcagcagactttaaagagtgcactggaaagcgctagggccgccaatgtggctaagagtcagttcttatcaaatatgtcacatgatatccgcacaccgatgaatgcggtcattggaatggctgcgatcgcggccgcgcatccggatgatccggacagagtgacggactgcctgaaaaaaattgatatctccagcaggcagctgctcagcctgatcaacgatgtgctggatatgtcgaagatagagagcaggaagctgacgatcagggaggaaccttttaattttgccgaattggcaacggatatcatagagcttttcaggccgcagacggcagaaagccggctgaagctggatgtgcatctggcaggactgaagaacgaagcagtaataggagattctcttcgtatccggcaggtttatatcaatatactgagcaatgcggtgaagtatacgccttcgggaggggaaatccgtgtggaagtgcggcagaaaaaggagattcataagggatactccagttttattttctgttgttctgacacgggaattggaatgagcgaggagttccaaaagagactgttcgagccctttgagagggtacaggatactaccagcagcaggattgtcggtaccggactggggatggcgattaccaaaaatctggtggacttgatggacggggatatccaggtggagagcaaactgggaaagggatctgcctttaccgtaaggattccgctaaagctgcaggcagaagaaccggaggcagtccccagggaatggagcggggtacgctgtctgattgtggacggcgacccgcaggtcagtgaaagcatggtggaactgttggaagacatgggaatgcatgccagctctgccgcctctgggcgagaggctgtttcctatgttttgcaggcgaaggaaacgaaagatccgattcggctggtgatactggatctggaaatgccggatatggatgcgggtgctgccgcacagtgtatccgggacgcgctgggaaatgatattcctgcgattgtcatgacggcatatgattggtcgggattagagagcgaagcccgcagctatggggcaacagcgattcttactaagcctttttaccgcaggaaaatatccggtctgcttaggaaactaagcggggatgaggaagtgaccaatccgatgttcagtggaactgccggtgatttcaatggaaaacgtgttctgctcgtagaagataacgaaataaatctggagattgcacgcacactgatagaagagagcggcgtccaggtggaggaggcatataatggtgaggaagctgtgcggaaggtatcggaatctgaggaagggtattatgatttgattttcatggatatccaaatgccggtcatggacggatatcaggcaacaaaggtgattcgggccctaaaccgggatgacgcattgaccctgccgattgtggcaatgacggccaatgcgtttcaagaagacgtatgcgacgcgctaaaggcgggaatgaacgtacatctggcgaagccggttgacgtggcggaattgggtcaaatcctgcagcgattcctggggcagaatatgtaatactgcaggtatcaatgtactaaaatagggaactgtgcacgatttattttatgcagcagttccctttttgaccgacaatgaaatgatctgttattcttccatatttatacaggaacacaggtaattataaaacgcttatcaagcagcttttttcggtgctgtcttaggataattgaaaatatttttcttaacaatattatagtaaataatacaaacaataattgtactcgttgtagcagtaggtgtagccagtgaaagatggaaaagtgttgcgcctgccatatggctgtaaatataggcagcaggtacacgcataacccatgaatcccagaatgcctggaaaaatacgaactttgtacggctgcagccattgtaaaatcccataaagcagaataaaataccaacctgtatacagtcgacagagaatcctttcaggtactgtgccgcagcagcgattacggtctggtcagaagtgaagatcgaagccagcacatcgccgtggaaacatacaaaataaaatacaataagtcctgttacaacagaggttcccatgccatagaagagagttctctttgctctttctggttttttagcacccatgttctgcgcaataaacgcagacattgactgcatgtatgagatcggtatcaataagacgaagctaacaacacgccatgcaataccgtatccggccgccatgattagtcccatgccgtttgcaaatgtattgacagcaagaaatgaaatctgtgtaacgagatccttcattgccacaggtgttccaatggaaaacatctctttgatcttttccttatcaaaccgaatatgttttaacttgaatacgaacggcagctttgtgaatcggataataataattgacaagataaggcttatggcctgtgcagctacggtagctatggctacgccctttactcccatatcaaatacggatactaaaacaatatcaccaacaacgttaattacacaggcgataataacgaaaaccaatggaagaatagaattgccgatacctctgaatatacagctcagcaggttatatccgacaataaaaaccaatcctccacagcaaatcgataaatactgaacggcaaaatcatgagcttctacaggcacgttcatagcgcttaccaatgctggcgttacaaaaaccatgataatcgttagaattacgccaaaaacagcaaatatgctgatagaagcccccatagattttgcggcactttcgccgtctttctctccgatatagcgccctattgctacagtaacacccatagcaagccctgtgacaactacctgaaggagatacattacattaccccccgaagaaacagcggcactttcggcaggcccgcagtaacggctgataacaattaggtcaaccgcgctgtataaagcctgtaaaaacatagatatcagaatcggaaacgtaaactttagaaatggggacaatatgggtcccgatgtaaatgaatttgtttcattattgttgctcatctttaaaccactcctctcaataagtgcataagtacatgaataacacagattttgttgatgcagaaataaccttaaaaacaaccttaaaaaatataccctaagtattgctgcttatcttcagctttgctctttctttatgacgtctaccaaaaaagagccctcgcggactgggctggagatcaagccgttgcttctgcaaaacacctgctggagaggcagacagcatacttaagatacaagagatacgagtatctgaatattctgaatatacattcttttcccccttacctcctttgaatgatatttattatatgatattttttatgtaagattattttatcatccgggtacctgaacaaacagtgaacaatgcacacgattattaataagaaagcatagagggctgagattaacgcttcagattatttattgagtactctcggaaacatttattttaattattgctgaagcgctgacataaaaactttcgaattctgcatactaaataagtataaacagaacctcttatattttagggtactacataccagtatcataaaatataaaaagggtcgtattttggcgggtgtatttttacaatccttaagaaatactaaaaatacaaaaaaggggtttccatttctggaaaagtttattatactattggtgcaagttggggagagactgcacggggaaacagaggaatttatctagaccaaggcgtgtttaaaaatatacttgaagagaaatttctgcggggcagaggagtacgaatgagtggagattaagagtaatatgggttgtggaagggagcgtaaatatgtctgtagatatcgggatagatttgggaacagccagtgtactggtgtatgtaaaaggaaaaggggttgtgttgaaggaaccctcagttgtagcgtttgacagggatacgaatgttatcaaagcgatcggggaggaagcgcgcctgatgctgggaagaactccggggaatattgtggcggtgcggccgctgcgccagggggttatttcggattatacggttactgagaaaatgattaaatattttgtacagaaatcgcttggaaaaaggacttttaagaagccgcgcatcagtatctgtgtgccgagcggtgttacggaagtggagaagaaggcggtggaggaggccacgtttgctgcgggggccagagaagtacatttgatagaagaaccggtagcggctgcgatcggcgcagggattgatatatccaagccctgcgggaatatgattgtggatatcggaggcgggaccgcggatatagcggtgatttcgctgggcggtacggtggtcaatacttcgatcaagattgcaggggacgattttgacgaggcaatcgtgcgttacatgagaaagaaacataatctgctgatcggtgagcgcacggcggaagatattaagattaaaattgggacaacatatcctcttgtcgaggaagagaccatagaggttagaggacggaacctagtgacaggacttccaaaaacagtcacggtgacgtcttcggagactgaggaagcgctgagggaggctaccggacagattgtagaggcggtaattgccgtactggaacagacaccgccggagctttccgcggatattctggacaggggtatcgtactgaccggcggaggggccatgctgcgcggcctggaagaactgattgaggagaagacagggatccatacaatgaccgccgaagaccccatgaaggttgtagcgattggaacaggtcagttcgtagaatttatgagtggcaggactgacttctaagggaggaagccagggtgggacagactgcttcagacggtgcaatgcgctgttgaaggggtctgtcttaacttatgttacgaaggagcctgccggatgttccggggatattctgtgggatgaaaggctccggttaggaggaaattttggaagtagtcaccggatatgtggagcatattgtgttccggaatgaggataatgggtatacggtatttaatctggaaaatgaagacggggagactacctgtgttggcagttttaactatattaatgagggggagatgctggaactgcatggggagtttgttaaccacagtgtgtatggaagccagctcaaagtgagctcccatgaggtaaaggagcctgaggatctggtatctatagaacgttatctgggatccggggccgtgaagggtgttggagcggcgctggcaggaaggatcgtgaggaagttcaaaaaggatacgttccgcatcattgaggaggagccggagcgtctggcggaggtgaaggggatcagcgagcgaaaggccagggagattgccgtgcaggtagaggagaagaaggatatgcgccgggcgatgatctatctgcagaaatatgggatatccacgacccttgctgtcaagatttataagtattatggaacgaaactgtaccaggtgcttgaggagaacccgtaccagctggcggataacatagaaggcgtgggattcaagacggccgacgaaatcgcatccaggatagggatacatacggactctgatttcagaatcagaagcggtattttttacacgctgcagcagtccaccctggagggacatgtctatctgccccaacaggtactggaggcgcgcgccggaaagcttctgggggtgaacatccaggatgttgaaaagtatatcatggatctctgcattgagaaaaagacggtgcgcaaagaggcggagggcgagatcaggatctatccggcccgctattattacctggaactcaatacggccaggatgctgcatgatctgaatattgactgcaatatgccggaggacatgatggagaagcggctcagaaaggtggagcggcaggaacagatttccctagaccccatgcagcacaaggcggtgatagaatccatcaagcacgggcttctggtcctgaccggcgggcccgggaccggtaagacgactaccattaataccatgatccagttttttgagagcgaggggatgagcattctgctggcggcgcctacaggaagggcggctaaaagaatgacggaggccaccggatatgaggcacagacgatccaccgcctcctggaggtcagcgggaatccggaggaagagggcaatgtaaatggctttatgcggaaccggcaaaatcccctggagacggatgtgctgattatcgatgagatgtccatggtagaccttccgctgatgcatgctctgctttcagccgttgtggaaggcacgcggcttatattagtgggggatgtgaaccagctcccttccgtgggacccgggagtgttctgaaggatataatagcttcggactcgtttccggtggtaacgctgacaaagatattccgtcaggcaggcgagagcgatattgttgtaaacgctcataagatcaatgccggggaacctgttatcctgaacaacaagagccgtgactttttctttttaaaacggcaggaagcggatgtgattatcagtgtagtgattaccctgattcagaaaaagcttcccaggtatgtggatgcacttcccacggagattcaggtcatgactccaacaaggaagggcctgctgggggtggagcggctgaatacaatcctgcagcgttatttgaatccgccttcgccggaaaaaacggaaaaggaaagcgggcaaagattgttccgcgttggggataaagtgatgcagataaaaaataactaccagctggagtgggaaatctgcacgaaattcggactcactgtggataaaggtatgggagtatttaacggagatatggggattgtgaaggaaatcaattcctatgatgaatcaatggttgtcgagtacgacgagaaaagaacggtaaagtaccccttcgagatgctggaagaactggaactggcatatgccattacggttcacaaatctcaggggagcgaatatcctgcggttgtgataccgctgctgcagggaccgcgtatgctgtataacagaaatctgctgtatacggcggtaacccgtgcaaaaaaatgcctgacaatagtggggagtgaagcgacatttcaggaaatgatacagaacaaaaacgaacagaaccgttatacaagcctggcggagtgtatacgcggattttaaatctgctatatccgcaggtttgtccgttctgtggcagaatatcggaacaggggatctgcagtgtatgtaaaaagaagattatctatgtacaggaaccacgctgcatgcgctgcggcaagccgctggaaaaggcggaacaggagtactgcagggactgcacagaacatgatgccgcctatgaacaggggcggagtgtatggctgcacagggagcctgtttcggacgcaatttatcggttcaagtatgggaataagaggaactacggccggatatttgccatggaaatggcggaacattgcggggctcagatcagaaggtggggagttgaagagatcattccgattccgctccatcccgccagaaaaagaaaacggggatataatcaggcggaaatactggcggaggagctgggctgccttcttcacatacctgttaggaaagacgtgctttacaggatacggaataccaggccgcagaaaagccttaatgacacggagagaatccgcaacctgaagggggcctttgcggtggccggaaaagagaaagtaaaggcaaaagtactgatcatagacgacatctatacgaccggcagcacgatccgcagatgcgcaaaaatgctgagactagcaggagctgaaaaagtgtattttttaactataagcattggacaaggactctgagtatatgctatactaaaaatgatatttatcttaaaagaagataagaatcccacctttacaggtggttaagaaaaattaaatttaggagggagccttgtctccttccaggataaagccgccggcgggcggcagaggcgcgcagaagtatgatgtcatgcagggcatgacgcgcgcctcgccgcaagtacgccaaggcgtgcctgcactgaaagaaaacatagaggtgaggaaatgttagataaggaacgcatcaggctgatgacaaagatggcggcatatgagaacactttggcgccggatgatttgaaaatcagcagttattataagaaagattattcaagcctcaacacactgatcacagcgatctgggtcacgatcggatacgccattgccgcaggtttggttatactgtgcaatgtcgacgcaatgctgaaggatctgacggttgcaaagctgattataatcgcggctgtcgtggtgggtgcatatattatcttacttgtggcttactgcgtatgtgccagcagcttttataagtcgaagcacaataaagcaaaacagcgtgtgaaaaagtattaccgggatttatcccgcctgggaaagatgtgtatgaaggagaaaaaataaaatatgagtactttacttgtctggaaagagcaactgcaaaaaatatatgcgaagtattccacatatataatgaaagcattacaatttattttaggactctgtgtcttcggcctgattaattccaatatcggttttatgaaggcggcatcgtctattgtctgtactgtggggctttccgcagtctgtgcatttctgccgctggtcgtgatggtgatcgcagccacggtgctggtactgctgcatttttataccttatccatgcccatagctcttgtatctctggcgatctttctgatcatgtacatcttctatttccggtttacaccgaaaaaagcatggcttgtgctgctgacgccggttgcgtttgcactgaaggttccgttcgtcattccggttgccttaggcttactgggaacgccggtctgtgtgcttcccgttgcatttgggacgatcgtttactatatgcttcacttcgtgaagatgtcatctaccgccctcaagggaggggatgcaaaaggcttggtggacagcctgatggtttttacaaaacagtctctgaccaataaggagatgtgggtaatggtgattgcaactgccgtcagtcttctgattgtatatgccgtacgaacaagatccgttgaccatgcgtggaagatcggatcggtcgctggcgcgattgcaggaattgtcatcgctgctgcggggaatattacactggatgtgcatctgtcatacgttacaatggtggtcagcggtgttgcagcgattgtggttgggctggtgctggagtttttgttcttttctgtgaactattccagaacggagcgtatgcagtttgaggatgatgaatattattattatgtaaaagccgttccgaaaatagtagtatctgcacctgagatgagtgtgaagcatattaatgaaagacaggaccagagtgaatggcaggaattacaggacagtcaggagacggtgctgattgatacttcaaatgtacagagggcggcaggggagccgcattcgcaaaggaagcgcccggcgctaaagcaggaagaacacgcgaaaaagatagatcacgccagggcagcggacgagattctgctgacaagaagccttaccaaagaattgggtataaatcttgaagatctggaagataaataatacctaaggggcactcggggactcatgttctttgggcataagatgaataaagggagcagcattcttaattaagacaggaggtggcagaatggaacagtggatcaaaacgttttttgacaactatgtgagcgacatgtactttccgaatgttcacctgacagatatcatagagattatcattgtatcgatcatcgtctacgagattatgctgtggattaagaatacaaaggcatggatgcttttgaagggcatgatcgtcctcggcttgtttatactggtagctgctatatttcgaatgcatacgatattgttccttgccagagagtcgatcaacgttctggcaatagccgctgtggtagtatttcagccggagctgcggcgggcgctggaaaagctgggggagaaaaaccttctgagcaatatcaatctgtttgacagaagcagagaaaaccagaggttctccgatgtaacgctggagagccttgtaaaagcctgttttgacatggggagtgtatgtacaggggctttgattgtagtagagcaggccattcgtcttacggaatatgagatgaccggaatcgagctggactgcaaagtctcttctcaggttctgctgaatatatttgaacataatactccgcttcacgacggagctgtaattataagaggagacagaattacttcagccacatgttatctgccgctttcagataacatgtcaatcagcaaagacctggggaccaggcacagagctgcattgggaatgagtgaagtaagtgatgcactgattattgttgtatccgaagagacaggccaggtttccgttgcgatgggagggcagcttgcgagaggagttacgccggaataccttgctacaaggctgaaccaaatccagtatagaactgcggaaggcaagaaatttactatacggaaaggacggcagcggcatgaagaaatataaatttacgaacaacctggggctgaagattatggcactggttttcgctgccctgttgtggctgatcgtagtgaatatagatgatccggtggagacgacgaccttccggaatattgatgttacggtacagaatactgaggttgtgacaaatgaaggaaagacctataagatattagacgatacacagaaggtaagtgtggtagtgcgtgcgaagagatcagttctggctaaactgtccagcagcagtatcattgcgacggcggacatgagtgagatgcagatcagttcactgattcccatcacagcaacagttcccggttatgaaggcaagtataccgcggaagcaacaccaggcaacctgaaggttaagatagaggatcagacaaagaatccattcccggtgaatgtcagcgtgacgggcattccgcgtgacgggtatgtagtcggcaatacgccgaccaatccggcaaaggttaccgtgagcggggcggaatcactggtcaacagtattgataaagctgtggcaaaggtggatgtatcgggattgtccaagacgacagtactgcaggccgagctgacctattatgacagtaacggcaatccggtagataagagccagttgaaagataacctgggggaggatggcattaccgtcgaggtggagatactcaatacaaagagcatagcattgaatttcaatgttatggggactccggaagaagggtatgtatacagcggccttaccagtgaaccggagcggattcaggtctgcggtacggcggaggccctgagcgggttcaccgaactggacgtaccggcctcggagatagacatcagcggggcaacaggaaagctggagaagacgatagacatagtgccatatctgccggatgggattaagctggtggacgagaccgccaataatgttgtagtcaccgtatccatagagcaggaaggaacccgtacaattgagcttctcgcagaatctatccgggtcatcaatgtacaggaaaatctcagggtatcctttgaggacaataccgatattcagctgcagtttaaaggagcgcaggaggcgcttgagaaactggatgtgaaaaatgcagtatatatagatttaaagacctatacaaaaccagggacacacgaagtaccggtgaatgtagatctggatatggacggagcgaacggttccaatattgtattgctgaagaacccaacggtgaaggttactcttactgagaaagatgaaaaagaggagcaaaatgtaacaaaggaagaataacgggaggagagagttcacatggtaagcgaaaaagttacgataaagaaccctacaggcttgcatctcaggccggcaggcttgttctgcagaactgccatgcagtacggcagcaagattacggtagaaaagaaaacaaagtctgaggatgtcacggcgaatgccaaaagcgtgttaagcgtgcttggcgcctgcattaaaagcggagatgagattcgaattatctgtgaaggagacgacgaggaaaccgcacttcgggagatggtacgtattgtagaagatggtttgggagaatagaatacagcctgtgagaaggcaggaataaggagaaaaagatgagcaaggcaacattagtgatcatggcggcaggaattggaagcagattcggcgggggcattaagcagctggagccggttgggcccaatggtgagattatcatggattattccatctatgatgccatggaggcaggatttgacaaagttgtatttgtaatcagacgggatctggaaaaagactttaaggaagtgatcggaaacaggatcgagaaggtaatcgatgtcgattatgttttccaggaggtggatgatattccagagccatataaagagcggtttgccggaagaacaaagccatggggaaccggtcaggcaattctctgctgtaaggatgtggtggacgcgccgtttctcgtaatcaatgcggatgactattacggtaagcaggcattcaaagaagggtttgaatatctcacggccgagtcccgaagcgatggcatggagatctgcatgatcagctttgtgttaaaaaatacactgagcgataatggggcggtaacccggggtgtgtgcagcgtggatgaaaatggcatgctcgcagacatcgaggagacccataacatcgaaaaagttgacggccgggcggtcgtgcagaaggaatgcggcagccgggagattgatgtggagtctccggtttccatgaacatgtggggactgaggccggacttcttccagatacttgcagatggttttgaagagtttttgagtatgacagatgaggagaacctgaaagccgaatacctccttccaacgattataggggagctgctgggagaaggaaaactggccgtgaaggtgctgaggtccggggataaatggtttggagtaacttataaggaagataaagatgctgtggtttcagcggtaaggggacttgttgatgcgggagtatatccggagaagttattttagaattgagtgagaagaaggcatgtgtatcctaaaaaaggatacatatgcctttgtgcttgaaagtgttctattgacaagggcaggagaaagtatatatacttagcaggtggcaattgtttattacagaaaggagaggctagatgacaaagaacataagaagattaattgcggcagtacttggtattagtatgatagcacttggagcgccagtcaacgggacaatcagttatgcagcatcggagtatgaagatccgtcaacacaggattttcagaaaatagataacagtggtgaaccttcagtatatggcgatcaatccaaaccagaaaatgctgataatacagaaagtggtgaaactcaaacagatggcgcagaaaaacgcgagaacagctggcggtatgaggacgggaacctgatttcgggagtagagctatatgcacaacatccaaacgcatgggaaaaggtcaacggtgtctatgtaaacagtgtcggaaatataatcaaaggggcagtgaaaaaaggcattgatgtaagtgaacatcagggaaaaattgattgggaaaaggtgaaggcagctggtattgattttgctatactgcgttgtggatatggtaatgatgagtcatatcaagacgatggtcagtgggcgagaaatgtatccgagtgcgaacgccttggtataccatatggagtatatatctactcatatgcgactaatctcaatatggccaaaagtgaggcggcgcatgtcctgcgtcttttaaagggccataccccttcatatccagtatatctggatatggaagaccgtactaccgaaggtgtcggaacaaagatgctgggtagtatagcaaaaacattctgtgatacaatctcaaatgcaggatataaaacaggaatctatgcaaatctggactggtggagcagacttctgacagatgctgtatttaataacagttcctggtcgaaatgggttgcacaatataacacaacctgtgattacggcggcagttacgatatctggcagtgcacctcatcgggaaaagtaaatggtatcaacggcaatgtagatcttaatttttggatggatgataccctcccttttgaggatttaggcaaagactgctggtgttatgacgcggtttactatatgtactggaacggcctgatgacaggactgaattccacgacattcggcgcatctgagaaggtgagcagggggcaatttgtgacgatattgtatcgaatgtcaggatcaccggaggtgtcatattcaaccagatttccggatgtaaagaataatgagttttttaccgaaggagctttatgggcatcttcggcagggattacgacgggatatgagaacggctgtttcggtccggcagacgagattacacgagaacagatggcggtaatgctgaacagatatgcaaaataccagggatatagcgtaacggccagcggcagcctggatcagttccgtgatggggggatgaccagccagtttgcaatagaagcagtgagatgggctgttgggactggaattatcagtggaaatggagatggttcactcgctccgggcggtgcaactgaccgtgctgcatgcgcaacgatgttgatgcgctacagaacaggaatagaaaaaagataaaagtgaggatatgtaatggaagttacaattatcattccaaattataatggcagacattttatggagccatgtttgaaatctctggccaggcaaagctatcaggatttcaggatacttgttgtagacaattgttcaacggacggaagcctggatttcatgagagaaacatatccgaacatacaagttgaagcgctggataaaaattatggatttagctatgctgtgaatcagggcatcaagatgtctgatactccttatgtaatcctgctgaataatgacactgtggtcgaaaagcattacgttgaggaaatgatcaaggcaatgaagagagatcataagattttttcagttagcagcaaaatggtccaactgtaccatcctaaactgatcgatagtgcaggggatctgtatactctgctgggctggggaatctgccgcggggccggccggtctgtggagaattacagaaaggttgatcagattttttcggcttgtgcgggagctgcaatctatcgaaaggccgtttttgataaaatcggatactttgacgaaagccattttgcttatttggaagatgttgatatgggataccgtgccaaaatatacggatataggaatacttactgcccgactgctctggttcgccatgttggcagcggtacaagcggatcaaagtataacacattcaaagtaaaattatctgcaagaaacagcatttatctgaattataagaatatgcccgtatttcagctggcattgaactttctgccgctggcagcggggtacgcaattaaatacttgtttttctgcaaaaatggttttggaaaggattaccgtgatgggatcagggaagggctgaaaacattgaatggctgccacaaagtgcccttccaatggaaattcttttttaattactgcaggatagaatgggagctttttgtgaatacattggcttatgctgcagactggggaaatagaaaattgaaacagaagtctgaataggcaatgacaatagagtagaatcggagtctgcagtggtaaagcgctgcagactccgatttatcgggagagttacggatgagattgattgattttttaaagaaaaacagaaccgtttttatcacagcaggagttctatcgtttctgtgttttatctatatgattgtaaagccgggaatttcaatagacgaagaaacctggatacagattgaggaaccttttactaaatggtttgtccagggaagatggggaattgatttatttaactatctcgccatggacaatgggaggtatgcgccggtattatgggatattcttgctattgccctgtggaatgcaggaggagcgctgttcggattcactctatttggtgataacgcaaagaaagttccgctgttctttttccaggcatacttttgttcactgccatttgtaatgggggaaatgttttctttttctatgtttagcttacaaattgcttcaggaatgatatttacagcatggggattcatgctgagtgttgaggcggccgaagagaacggcagaaaaaagtggatttattccctgttgatgctaatatatgcatttgctgtttatcaggcatacacttgtgtttatgtgacagcagttgtggcatattgtttgaaaaactatttggaaggacaggtccggattggcagtaaactgataagatgggcgggagtgtttgcaggaggccttattgggtactatggaatttatttgattcttatgaagctgttcggagcatccagctatctcgcagataattatgtgggatggtttgatgagggcggcattggaaaggcactattcatggcgtttgctaacatcgtaagagtttctttcgcgattccaattgccggggagtacatatatggtggtgaagtgatacggattgttaccactttatttgtggtttttgccgtgtgggctttctttaaagcgaattttgcgcgcagaagactggggattctgttttatacggtggcattggcggcatccccgtttatattatatctggttcttggcacgtacaaaacgcacggacggacactgctgggtcttgccctgtctggcgcggttgagctctatctgattctctctgttttgaaagcgccaatgctgaagcggctggggatgattggaggagcatatctattgtttctaaacgcgaaaaatatgaatatgctcttttactcggcaaatgttgcttatgaatatgatagtaatgtggcaaaccaggtgatgtacgacatgaaaagacagggaataaaatatgaggataaggcagttgtattcatcggtatggaacccatggatgaagtagggcttcagaagtcagatacggtgggcagttctatctttgaatgggatgacggtaatatctccagaatgtgtaattttatgaaaacggaagggtactgcctgaatcagccgacacccgggcagatagaacaggctctggagatgacgcagggaatgaagccatggccgcaggataatagtataaaagaaacgcaggataccgtaattatatttttttctgagcccacagacaaatggtataaagttaatctggggcgatagcccccttttttatgaaaaactaataatattacggaattattaagcaaatgttaaagaacatagagatttcacttgtccttttactgaaaatattgtatcatataacagataatgtacaatctaatttgtgaataaaaattagcaatagtaatgaaacttcgggataacccgtaatacatgcccttcgggcggatctgcagtatcgctgcagaatatgatataatatataaacgagtaaggtgaaaataatgattaaagataatcagaaatatttgaaccggatgcaggtggtattggacgggctggttatcatagcttcttacgcacttgcttggtatctgcgattcagaagcggattgatggaggtagatgaatggtatctgccttttgaaatctatatgcgggcgctgacatatatcgttccgggatatttgattttatacggatgttttcaggtatatacaccaaagcgtgtacaaggcagaagactggaagcatggcatattacccaggcgaatgttataggattgctgggtttcatcctgattctttatttgacaaagcagcccaacttttcacggaagatgattttcgtgttctttcttgtgaatgtttttctggaagtgctgtcaagaaatctgatccggtattttctccgcaatattagaaaaaacggatacaatcaaaagcatatgattttggttggttacagccgtgctgcggagcagtatattgaccggataatggcaaatccggaatggggatattccgtcagagggattctggacgaccatcagccgagaggtacggagtataagggcgtaaaagtcatcggaagtattgataatctcctgattattcttcctcagaacagagttgatgagatagccataactcttggtattgatgagtatcataagctggaatatattgtaaacatgtgtgaaaagtccggtgtgcatacaaaatttattccggactataataatattatccccacaaagccatatacggaagatctgcttgggctgccggtaattaatatcagacatgtgcccctgaataataccgttaataaagtagtaaaaagaagtgtggatatttttggcgcgatcgtggcgattgtattgttttcaccaataatgctggctactgcgctggctataaaagtgacttccccgggtcctcttatattcagccaggagagagtgggactgcagaataaaccgtttgccatgtataaattccgctctatggtagtgcaggaggcagaaaaagagaaaagcagatggactacaaaaaacgatcccagagttacaaaagttggaaagtttattcgcaaaacaagcattgatgaactcccacaacttttcaatgtactaaaaggtgatatgagcttggtcggcccaaggcctgaacggccgctttttgtagaaaagttcagggaggaaatacccagatacatggtgaaacaccaggttcgtcccggcctgaccggatgggcgcaggtgaacggccttcggggagatacttccattagaaagcgtatagaatacgatttgtactatattgagaactggacgataggatttgattttaaaatcttgttcctgacattttttaagggttttgtaaacaaaaatgcctattaggcaaagatcaattttaaggggaagtgaaaatggctagaaaaaaatccaagggtagaatgacaaagcagcagcgtgctttgttacataagaaaaagatgagaaaaagaattatactgctagtagtggagatcattcttcttcttgttttgggagcagcagcttatgcaatgtccaaattggacaaactggattttcagacggttaacacctcaaacctggaaatttatcaggatacgggagaatttaccaatattgcactgttcgggctagactccagagaaggagagctggacggaggagtaagaagcgacagcatgatgatcgcaagtattgacaataaaacaaaaaatgtaaaaattgtatctgtgttcagggatacactgactcagcaagatgatgggacatacgaaaaggccaatgcagcatattcatttggcggtccggaggaggccattgcattgctgaaccggaactttgacttggatattcaaaagtatatgagtgtgaattttaatgcccttgcagatgtaattgatttgttaggaggaatcgaaattgatctgactgccgaggaagtattttggacaaatgggtactgtactgaaacttcacaggttgtagggagaaaaacaacagaactgactcagccgggaaaacaggttttagatggtattcaggcagtatcatatgcaagaataagatatacggagggagacgattataaacgtgccgaaaggcagagaactgttttgcagaaggtggtagaaaaggccaagacggcgagcctgtctacattaaacaaaattattgatcaggtactgccgcaggtttcaacgaatttatctacaagtgattttgttgggcttgcagcaagcgctgccagatacacgatcggagaaatgacaggatatccgttcgatgttacgacatcagaagatgtaattgggctggaaggttcttttgtcgtaccgatcggttttgcagataatgtcaggcagctccacaaattcttatttaaagcagaaaattaccaggtgtccgaaaaggtactgcagatagacagcgatgtggcctatttaaccggaatcgctggttcctataatgacaatgccgacagtacagacgctgcagggggaaccggaggtgcgaatggctacgggccggcagatactcaggatactggggattatggaaatctcgacagctcagatggcagcgaatatgattacggagataatgcaggatattaggagaaaataatggacagacccacagtggatataatcattccgacttacaaaccggatataaagtttgaaaagctgatcagaggactaataagacagtcataccctatacagaatatctttattatccacaccaaaggcgggcgcttcccttgggagacagcaggcctggatggcagggtgactgtgaaggagattgagaaggataagtttgaccacggggggacacgccggatggccgcaggtttaagtgatgcagatatttttatctgtatgacccaggatgcggttccagcagatcgtgatcttgtgaagcatcttttacaggcttttgagaatgataaagtggcttgtgcctatgcaaggcagctgccggacgagaagtctgatgtgattgagcgctatacgagaagctttaattatccggcagaaggctgtataaaggatttaaattcgattgataagatagggattaaagcattcttctgctccaatgtatgtgccgcataccgaaaaacgtattatgatgaacttggagggtttgtgaaaaaggcagtttttaatgaagatatgattatggctgggagaatgctgaaggcagggtacagctgtgtatatgctgcaaaagcagaggtgatacactcacataattatacttgtatccaacagtttaagagaaattttgatgttgctgtttcacaggttgataatccagatgtgtttggcggcattaaatctgagagtgaaggaatcaggctgatgaaaaatacagcaggataccttattaagataaggagaccctggctgatcatgccgcttgttataaaaagtggatttaaatacctgggatataagctgggacagcattataagcatcttccacaaaggctagtagtaaagctctcctcaaatcctaaatattggaactgaagcaggaagaatacggaaattaagattgaagtttagctggaagtattgtatgattaattgtgatcatgaattcgatattttaggaaggatttacaatggcgagaaaaaagaatataagaagacgcagaagaagagcaaagaggggatttgcatcttgggcagtatggaagaaggctctggctattgcgggggggactgttgtcctgctgacaactgccggagtagcctttgcggcatcgaagctcaataagatagaaaccacgaagctggatgcatcaaagctgaatatatcgacagaagttgagcataatgaaactggatatctgaacgtggcgttgtttggcctggataccaggccggggaatccggaagagggggagcgaagcgatacgatcattatagcaagcctgaaccgtgagaacaaagaagtcagattatgttccgtattcagggatacgctacttcaacaggatgacggatcgtacaataaagcgaatgcagcctattcttttggtggccccgaagaggctgtagccatgctgaataaaaatctggatatggacatacagcattatgcaacagttaattttaatgcgctggtggatgttatagatgaactgggcggtattgaactggatcttacatcagaagaagttttctggactaatggctactgcacagaaacatcaagggtaacaggcaagaccacaaccgaactgacgcagcctgggaaacagatactggatggcgttcaggccacatcttactgcagaatccgctatacacagggcgatgattttaaacgggcagagcggcagcgtacggtattggaacagattgtcaagaaagcccagacagccgatcttacaacgattaataagattattgataaagtttttccaatgattgaaaccaacttttcgctgacagaaattttagcatatgccaaagatgcttttgaatataatttaacagaaatgagtgggttcccattcgataaatcaacagcaagtttatccggtgtaggaagttcggtggtaccggagacattgcaaagtaatgtcctgcagctgcatgaatttttcttcggtgatgacggatacagtccgtcttctaccgtaacggttataagttcggagataggcagttatgctacgaatataattaccgatgaagaggccgcaacttatgaaccacaagagggcagctattattataatagcacaccccaggggaatgatgatggaagcacagaaaattcggatgctgccggaggcagtacggggaatccggacgggactggtgatggttccacaccggatagcggaggaaacagttctgaaacaggcggaaacttcgaacagccagagagtggagccgaaggaggaacttcagatcaggtaagtggagcagtacaataaaagatggcaaaagaggtagataagatgaagaaagcatttaaacagataggagtcgcaatattaacattgtgcctgacggtctcttgtttttcatttgttgcattggcggcagaagggactctgcagttttcagacccctcagcggcggctggggaaaatgttacggtaacagcaaaggtgatttccaacgcggaaggtgttgctgtgggcgacacggatattacagtcacttatgatccttctatattaaaattcgtcagtggaacaaatgcaacaggcggtgatggtacggtcaaattgtctgccaaaggtgacggaacctcaatggaagtaaattactctatggagtttacggccctgaaagaaggaaccgcaacacttgaggcgaaagaatatacggcatatctggccaatgatgaagcgctgaatcttactcttggtacttcacaggtgacaatacagggcggtactccggtttctgaggaagaagcaggtgaaaatgaaggccaggcaggttcagacggactaaaggtaaccgtagacggaaaagaatatacggtaaatgcaaacttctcagaggccgtgattccaaaaggattcacggcagcagaaacggaactggacggccagaagacgaaggcaatggttcaagagaccagcgggcagtatattttctttctgcaagacagcgacggcaattctgactatttcctttatagtgacgatgacggctccttttcacagacagcggtagtcgatgttaattcttcgctctctatctttttaatggaacacaaggacaaagaaggtcttccggaagagtataaggagacaacaacggatattggtggaaaggtgtttactgcctggcagaatacatctgaaaaagagtactatctggtatatgcattgagcagtgagggcagcaaaggctattatcaatatgatactacagaaaagacctaccagagatatacgcctccagtggtagaaaaaaaagagagcagcaatacgctgactgataaacttacaaattttataaataaatatatgacaattatattatgcgcggtatggggcgtgttccttgtcatgctgattattataatcgtcctgggcgtaaagctgagccgcaggaatcaggagttggacgacctgtatgatgaatataacattgatggggatggacaggatgatatgccgaagtcaagaaagagggacagagatcagtttgtcgggttccaggatgatagtgatgaatatgaagacgattacggcgatgattatgatgacgatttcgaagaatatgatgaagacttcgatgacgagtatgcggatgacgatgattcctatgatgacgaatttgaagaatatgaagaagaaacaccctcagtcagaagcagaaagaaaaaagatgacgatgattattcagtagattttattgatctgtagcagtctgttgaatgtatcaatgtgaatggctgggggaaccagccatttttcatgatacagaaaacattgctctatatagaactgggtgctataatagataagaaaaatttgtggaagacctggcagtatcccgggatgctgccagttcgcgttatactgcagggtttcccctgatagattccattaccgcaaaagaagaggagaagtaactgttttgtcaagatatattcagaattttttgaaatttaaacctctgttgggggaactggttgcaagggatattaaaattaaatacagaagatctgtactgggcgtattgtggaccttgttaaatccactctgtatgatgattattttgtccgtggtcttttcgaatctgtttaaattcgatattgaaaatttcccattatatattctaagcggtcaggtaatttttaacttttattcagatgctacatcaggtgcgatgtcggcaataataggaagtgcagcgttaattaaaaaggtgtacgttcctaaatacttatttgttctgtcaagagtcttttccagcacgatcaatttgatggcatcctttacagcgatgctgattgttatggtggcaacaagaacggaacttcactggactgcttttttatttcccataccgctgattctgctggtacttttttcgttaggaatcggcctgatcctgtcggcagtaacagttaaatttagagacattatacatttatatggagtttttgtaacgggtctgttgtatttaacacctgttatttatccgatgtcgattttacctgattggttatataaagtggttatgctgaatccattgacgaatattttaatgatgttccgagatgtgatgttgaacaacagcatgttcagcttatcctccctgttgattgcacttattgaggcattcttgtctttggggatcggtctgtacgtcttttataagaatcaggataagttcattttaaatatttaggagttgattatggatagaaaaacagttgtaaaagtagaaaatgtatcaatgaagtttaacctttcatctgaaaagttcgacagttttaaagaatacattataaagagtattaaaaaccaggtatcttatgatgaattttgggcgctgaaagatatatcttttgaggtaatgcagggagactctctaggcctgatcggtctcaatggcagcgggaagagtacgatgcttaaaacaatagccggggtattaaaacctacccagggttccgtggcagtctatgggaatgtagctccgctgattgaacttggagcaggatttgattttgatttgacggccaaggagaacgtttatctaaatggtgcacttctgggatactcaaggaaaatgatggagggatattataacgacattgtggagttttcagagcttcatgactttatggatgtaccagtcaagaatttttcttcgggaatggtgtcccggcttgcgtttgctatagcaacgatcggcacgccagatatattgattgtagatgaggtgctgtctgtaggcgattttcgtttccagcaaaagtgtgaggagaggattcaccacatgatggattccgggacaacaatcttgtttgtatcccacagcattgagcaggtaaaatctatctgcaacaagattgtctggcttgagaaagggaagctcagaagatttggagatgcagaggaaatctgtgaagaatatagtaaatgctattgataagtgctgaggagataagatgaaaagagtaaaaagtctgattataattgttcttatactcgcggctgcatttttgtatgcccatataggaaaaaataatctggtatatgataagaatgtggataacagtcagtacattccaacaggagctgtagcaaaaatagaacagacttttgtaggccaggaggagacactggatggatttcgtgctaagtgccaggtaattggggatgtcacgggaatgaaagtaaaatactcactgttaaatatggagagcggcgagaaagaagcgcaggggactgcggatgctgaaaaaataaaaaatggacgcttttattattttaaatttgatactgtaaaaaattgtaaggggaataagtacaaagtcatttttgagaacgagagcgtggatgaatccaaaggaatagggttcagttttcagcctgaaacagagacgggaaccgaacttacaattaaaggtgtaaatacaacaggcacaatgatcgtaaaagtagtaacggaaagatttgatctagagacctttattgttctgttggtatttatattatatgtagcagtttttattaaatttttgtacagattgttcaaataggcagattcagaaagagaaggattgtatggattttaaatattatattgaccaaaaaaagttcaggataaaaccggcagaaagatatatccgtgtaaatggatggtgttttgagaaaaatggagagccgtttacctatgaatccgtagtgaatggtaaagtggttgagagcagaataaaaaagattgtacgacctgatgtacaaaacaagtttggcggaaagtatagtccggctgcggataccgggtttcacataaagacttatgtcgattgtggtgttactccggaaagttatcgtctctacatccgccggggcagctacagaaaatgtattgtttccatggaccgaaaagagatcattgctttaaaggatgagagtacgatttcttataatattgactggatacatgttgaacctctgaaaattatactatcaggatgggcagtatctacatcaggtacagataaggtacatgtcagtataagggatgatatggacaaggctctaaaagtaaaaatgcagaggacaaagcgaaaagatgtagaggatgcagggctcattgaggctcacaatgtggaatgcggatttatagttgaatttatatgcgatccaggaaaatgctatacactggttatagaagacggagtgaaacggaaaaagatccggcttgatccggtaaaacttaaaaagtacgagagagcacagcgcagcaagcagtttgcagtacggtttgtaaaggcattaaataaaaagaacatagaaaaagggatgaagtaccttcggaaaaatggattgtatggattgaaggatcacattttgtcctgtgtaaatgcacaggggaaaccatatcaacagtggtttgaggaaaacaaagctacagaagcagatttgaagaagcagagagagaccatatttgcatggcagccgaaggtcagtattattgttcccacttataaaactccggagatctttttgcgggagatgattgattctgtcaggaaccagtcctatcagaactgggagctgtgtattgccgatggaagcggtggtgacgaaaccgtggaaagaattcttgaggagtatgctgtcaaggacagcagaatcaaatattgtttactaaaagaaaatcttggtatatcaggaaatacaaatgcagcgctggatctagtgagcggagattatgtggggctgtttgaccatgatgacgttctgacaccggatgccctttttgaagtagcaagtgcattgcaggaatacagatacgatatactctatacagatgaggataagatgacaggagacggttcggagtacaatgatccgaattttaagccggatttcagcatggacttattccgttcccataattatattacgcatttcttcgttgttaagacagaaattattaaaaagattggtgggttcagaagtgaatttgacggatctcaagattatgatttgatgtttagatgcattgaagagtctgagaagatacggcatataccgaaaatattatatcattggagaattcatatgaattctgtagccggtgatcctgctagcaaaatgtatgcatatgaagcaggaaaacatgcaatcgaagagcacttaaaacgagttggaatcgaagcgtctgttgagcacgtgggactgtggggaatgtaccatgtaaaatatgcaactccgggagatcctaaaatatctattattataccaaataaagaccatatagaggacttagacctctgtattaaatcaattcataaacggagtatttataaaaattacgaatttattatcatagaaaacaacagcagcgaaaagaaaacctttgaatattataaatatctggaagagcaatactccaatgttaaagtagtatactggaaagaaggatttaattattctgctatcaataattttggcgtacagtatgctaccggtgaatacctgctgtttctgaacaatgatacggagatgataacagaatctgcgctctcagagatgcttggtatctgcatgcggaaggatgtgggagctgtaggagcgaaactgctgtatgctgatgatacagtacagcatgcagggatagtcattggtttcggaaattatgcaggacacgtacatgtaggactgaagcgcgatgactatgggtatatggtgagggctcggataaactgcaactatagtgcagtaacagccgcgtgcctgatgacaaagaaagccctttttgaggaggtaggcggctttgacgaacaatttgctgttgcctgcaatgatgtggatctctgcctgaaattaagaaaagcagataaactgatagtttataatgcattttcagagtggcatcactatgaatcaaaatcaagaggctacgaagatactccagaaaagttaaaacgctttgagagagaagtagaaaaatttcagaagaaatggccggagatactggaaaagggtgatccgttctacaaccctaattttgcaattaaccaggcgccttatacgttgccgtaagatgcagaaaaagtaagagttcagagatgcctgaactgttgaaccagatgagttagacacaatgaagggagttacattatgtgtggaatagttggatatgtaggtgaaaaacaggcagcccccattttgctggacggtttgtcaaaactggaataccgcggttatgattccgccggcattgcagtatatgacggacaagagatcgagatgaagaaatccaagggccgccttaaggtactgaatgagctgacccatgacggggcgaccctgccgggaacggtcggaatcgggcatacgagatgggcgacccacggggaaccgtccgatgtcaatgcacacccgcatttcaataaagaagagagtatcatcgttgtacacaatggaattatagagaattatctgaaactgaaaaacaaactggtcaataaagggtatgaatttatatcggatacggatacggaggtgatcgcccatctgctggactattattaccagggaaatccgctgcagacgatcacgaagattatgcaccgcatggagggatcctatgcgctgggaattatgtttaaagaccatccggatgagctttatgcggtacgtaaggacagtccgcttattgtcggtaaatccgagggaggctgcattatagcatccgatgtgccggcagtgctgaggtatacgcgggacgtctattttatagaaaacgaagaaattgtcagaatgactgcgggaactatggagtttttcaatgtggatgaggaaccgattgaaaaggaatccacccatattgaatgggacgtggatgccgccgaaaaaggcggatatgagcactttatgctgaaggagatgtatgagcagccgaaagcgattacagataccttttcaccgcgcatcaaaggcggtgatatcgtgatcgaagagctgaatatgacggacgaggagatacaaaagatcgacaagatcatgatcgtggcctgcggttccgcataccacgcggggatgaccagtaaatatgtattcgagggaatggcgaggattcccgtggaagtggacctggcctcggagtacagataccgggatcccatcgttgaggaggggaccctggttgttatcatcagccagtcgggggagacagcagattcactggcggccctgagggagtctaaggcaagaggggccaaggttctaggaattgtaaatgtggtgggaagttccattgccagggaggcagataatgtcatgtatacctgggcagggccggagatcgcggtagctaccaccaaagcatattcctgtcagctcatcgctatgtatctgctggccatgaaatttgcaaaagtacggggaaaaataaccgatgcggatctaaagacgtatattgaggacttgaaacggattccagatcaggtagaactgcttctgaataataaaaacagaattcagaaatttgccaatagatatctggcggccagagatgtattttttatcggaaggggaatcgattattcgatttctatggaaggttccttgaaattgaaggaaatttcttacatacactcggaagcatatgcggcaggtgaactgaaacacggcacgatctccctgatcgaagagggaacacttgtagccgcggttctgacgcaggaaaatttgtataaaaagatgatcagcaatatggtagaggtccggacccggggggcgtttgttctggctgttacaaacgagggcaacgacgaggtagagcgcgcagctgactatgtaatctatataccggaaacaaaccgttattttacaaattcgctggctatcatcccgcttcagctgtttggatattatatttctgtaggcaggggctgcgatgtggataagccgagaaatctcgccaaatcggtaacagttgaataaaatgacggctgtttcaaaatttgttaaataaataaacacaattccatcacaaagagcggctattatatcaatataaaatacaagagaaagaaggtatttgtatggaaaatcaatataattattacaatcccgaaggacagcaggggaatgctcagtataatagccagccggatcacgacagtcacagcagaaaaccaaaaaagaaaatgcccaaggctgtcgtagtaaccggatgcgctctattatttggagttgtttccagcgcaacatttttaacatctaatattgtgggcagtaaggtactggggctgaatgagtcatctaatacagcggcgaagaatacggctccggttaatagcagctctcttaccaaaacatccagtgtcatcacatcagatgtatccggtgttgtggaaagcgttatgccttccattgtttcaatcaccaatatgagtgtccagcaggtgcaggatttcttcggaggcatatcccagcagcaaagcgagagcgcagggacgggtatcattatctcccagaatgattcggaacttttgattgtgacgaacaatcatgtggtggaaggcagcgagacactgacagttacgttcgatgacggcacaagcctcgaggcagatattaaagggacagacccgtctcatgacctggcagttattgccgtgccgttggatacgatttccaaagatacaatggataagatcgcagtagctaccctgggagattctactcagttgaaagtgggggaaccggccattgccatcggaaacgcactcggatacggccagtctgttacgacaggtgtaataagcgcgacggatcgtgagagtacgactacagacactatgacaggtgaaacaacaaccagcgatgtcagactgattcagacagatgcagcgatcaatccaggaaacagcggcggcgcgcttgtgaatgcaaacggggaggttatcggaattaactcctccaaacttgtaggaagctctgtcgaaggtgtcggctacgcaattccgatcagcgatgtgtcagatattattacgaatctcatgaatcagcagacaaaatccaaagttgcagaagcggacagaggatatctgggaatcgaaggtattgatgtgacttctgagaatgcgcagagatttaatatgccgcttggtgtttatgtgacagatgttaccagcggaggcggagcaaaagcagctggaatgacgaaggggggagtcataacagcattgaatggaacaacgattgacagcatgaatacactgaaagaacagttaagatattatgcaaaaggtgacactgtgacgctgacggtccaggttccaggcagtaacggggaatacactgaaaatacctatcaggtaacattaggtgcaaaggcggaatagccttataggaaatcagatatatacctgcaggacatctttcatgtatgtcctgcagggacagaaagaacacacagcggcaggtaccgcataaataaaatacaggacgcagccttcatggtaaggctgggtcctgtattttaaatttatgagccgttcgtttgaaggggttatatcaacagatagagcttgctgatgcagctttatttacagccgcagtcctgacgaatatcgaattcaggattgatggcatagaagtttttactgtccagattatcctgaacgatgcgcaggctttcaccgaacctctgataatgaacaatctcacgttctctcaggaaacgtataggatcgcagacttctgggtctttcaccagtctcaggatattgtcataagttgttcttgctttctgttccgcagccatatcttcatggagatctgtgatcggatcgccttttgactggaacacggttgccgtccatggcatcccgctcgccgcttgcggccagagcgcaagggtatggtctacataataggtaccgaagccggatttctcaatttcttccggtgtcaggtttctggtgagttgatggacaatggcacagatcatctccatatgagccagttcttccgtgccgatatctgtcagaataccagtcacttctttgtaaggcattgtgtatctctgtgagagataacgcatagaagcagcgagctcgccgtcgggtcccccaaattgtgtgataatgatctgagcaattttcgggttggtctgtgtaatttttacaggatactgcagtcttttttcataaccccacatatactaacatcctccttcctgccatggccatggctcattgatccagtcccacctgtcagcgcaggaatagatagtagtatcaattgtaagaggaccatagtatgcggcatattctttcagagcctcatttctcatacggctgtactcgcgaaagtaagcgagtgcatcttcatcgcagggatgggtatccagaaaaagtttcacgtcatccaccgcgaagctgaccgcattgatatggtcaagtaaatcttttctgcatggacgttcactcatcgattacaccctcctcttccatgaaatggttttgagaggtcttcaaaaattgtacctctctgtaaccctttacaaggttcgtataaattccgccatttctgccagggtacgtatgccatagcaattgggaaatcttccaatgcatcataacggcatccacacggctgtgacggacggcgttccggagtgcggcattcacgctgttctggtttgtggtgttccggagtgcggcaaccgcattgttctgggttacgggattctggagctcggcaaccgcattgttccggttttcgtggttctggagtgcggcaaccacatggttccggtttgcgtggctctggagcacggcatccacaaggttctgttgagccgcactggcggcggtcagttctcggcatgggggcaggtgcaggacggcagttattattaccgttcggcatgctgcggcagttattattgttcatttgtctgccgtagcgcatattgttttgacaattcgccatttgcgatatctccttccatatcatttacaatattatagtatggaagaaaattaaaaaggttccactttacaatttggcaaaagtcttatataatataacaagtgaggcggggtgtggctcagtttggttagagcgcacggctgggggccgtgaggtcgcaggttcgaatcctgtcaccccgatcagagtagcagtgcataagagcactgcttttcttatgttaaacatgttatttggaattgatcatttttggcgaaaaatcatgccaatctcccatcttttaaaaaaagttgtttttatatgtaaaaaaagctataatataggacaagttatatagtatagtatcctttgatacgcggtagaacaggaaggcataataaaaggagataaatttttatgtgtggatttgcaggatttgtaggagaagttgaagatagagaacaggtactggtcaatatgatgaacacgatcgtacacagaggaccggacagtgagggcaggtatgtggatgaggatgcggcgctggggttcagacggctgagcatcatcgacctctcaccggtgggagaccagccgttgtataatgaggaccgcagcatggtgctggtgtttaacggagagatatataattaccaggatctgcggaaagacctagtggaggctggtcatctatttgtatcaaatacggattccgagactctgctgcacggctacgaggagtggggcgagaacctcgtagacaggctgcgcgggatgtatgcatttgcaatctgggatataaagaagaaaaaactttttgcggcaagggatatttttggcattaaacctctgtattatgcaaagatgaatggcgccctgatgttcggttcagaaatcaagtcttttatggagcatccaaaatttgataaggtctttaatgaggcagcccttggaaattacctttctttccagtttgtccctacgaatgagactttcttcaagggggtattttgccttcagccgggccattatttcacatatgaaaacggaaagatggaaataaccaggtactttgaacctcattttacgggagacagcaggaagtcctttgaggagattgtggaagatgtcgaacacgttatgaaagagtcggtggaaaaacacaaaatcagcgatgttgaggtcgcttcctacctgtcaagcggcgtggattccagttacctgacgtatctggggcaagtggaccgtaccttcactgtagggtttgacgagggtaaatacagtgagattcaggatgcaaaggaatttgcggcaagcatcaatatgcagaacgatgcaaaggtaatcacgcccgaggaatattgggacaaattatcggatatccagtattatatggacgaaccggtggcggatccagctgcgatcgccctgtattttttgagcgaagaggctgccaagaaggtaaaagttgtactttcgggagagggctctgacgagcttttcggaggctataatatatattgtgaacctctggagcataccggatttaataagattcccatgtgcatcagaagagtgcttggtaagtttgcggagcgttgtctgccaagaggagtgaaggggagaggatttctgatgaggcacggcaagacactggaggagcggtattttgcaaatgccacgaatatttttacggagcgagaagccagccgtctgctcaagaaaggatgtgagcccggaattcagaaggtaacccgaccactttatgaacgggtaaagggaaaagacccggtaacgaagatgcagtacgtggatctgcatctgtggcttgtgcacgatatcctgatgaagggcgataagatgggaatggctaattcgctggaggtcagggtgccgtttctggacagggaggtgctggaactggccgagacactgccgctggattataaagtgcgcgcaccaaggactaaggtggctctgagggcggccgcagataaagtaatacggagtaagacggcagaaaagaaaaagctgggctttccgattccgatcagagtttggctgagggaagagaagtattataatatagtaaaaaagatgtttacatccgaagcggcggagaagtttttcaatacagacatgctggtgaaaatgctggatgagcataaggatggtaagaatacaaatgagaaaacagacaacagccgtaagatctggacggtctatattttccttgtctggtatgacagattttttgagcatggcaaaccggtgcatccggctatgagcagcagataggaaaagaaggacagctggccgaagccgatggcggccggctgttttaaggtgtctgttttcgtaatatgccacaagaatacctggcagaagtaaacagatgagatcttttgtaaaaattcaggaacaggggagatatcatgagaagcaggacagtgcagccgattcgaaataacgggaggaagcgtgcaacgccgccgggcagaggcggcagtgatggcagcagtatagaagccaggagaaagaggccggacgcaacacggcccatgcagagcgttccgcactctccgccgcctgcggaaaaaaaggccggaaagaagaagtgggtgaaaaagggcatccggtattttgattacgatctgctgctggtgatcatttttctgatgtgttttggtctggtgatgctatacagtaccagcgcctacagtgcacagtcagactttgagaacgatatgtattatttttccaagcaggcggtcatcagtgttttgagttttgccgctatgtttatagtatccaagattgactatcatatatatggagcgtttgcgtttgaactttacatattcgctatgattatgatggctctggtacagacaccgctgggaattgaaatatatggagccagaagatggatccagctgccgggaaatttgacgctgcagccatctgagataaccaagatagcggtgatattgtttatatcctatgaattgtgcaggctggggaagaaaatcaatacgagagaagggcttgtgaggattatggcattcggtgtaattgcggccgggggtgtcatgtttctgacagacaatctaagtacggcgattattgtgatggcgatcacctgcatactgatttttgtagttcaccctaagacaaagccttttatcgcggtggtgggagcatttaccgcagtggcggtcgtggggatttccgtgatggcggcgaccattaccacaagtgaaaactttcgtctgcgccggatcattacatggctggatccggagaaccacgcggacaaaggcggcttccaggtaatgcaggggctgtatgcaatcggttccggcggattttttggaaaaggtctcggaaacagtacacagaaactcggggtaattccggaagtgcagaatgatatgatcctatctattgtctgcgaggagctgggggttttcggcgcgattgtgatactggtcttgtttggccttttattgtacaggctgatgtttatagccagaaatgcgcccgatctgtacggttccctgattgctaccgggatttttgcccacattgcacttcaggtaattctgaatattgcagttgttaccaacttgattcctacaacgggtattacgcttcccttcattagttacggagggacatccatcttgtttctgatgacggagatggggattgcactgggaatatccagaaaaatcaaattgggtgacgggtaattaaaaaaatatcttttcatacgatataaagtgtgctatattagtatgtagtatttaaaactacatataatagatgcggaatgcactatttgtagtgtgggaggatataatatgagctataaagtaattgtagacagctgcggtgaattaacggaagatatgaaaaaaagcgggctttttgagaccgcttccctgagtatggaagtgggcggagtccggatcatagacgatgagacatttgatcaggccgattttttgagacgcgtggcggcaagcccggaatgtcccaagtcttcctgcccgtcgccggaagaatacatggagagatatcactgtgaagcggacagggtttacgcggttactctgtctgcggaactgagcgggtcctataacagcgcggagttgggcagaaagctttacaaagaagaatatggagaaaaagacatctatattttcaattctcgatccgcatccgtgggagagaccctgattgcgatgaagatacaggaatgcgaagaccggggaatgacgttcaaagaggtgattgacaccgttgaaagatatatcgcggggcagaatacttattttgtacttgagaccctggataccctcagaaaaaatggcaggctgtcgggtattaaagcaatcgtggcaagcgccttgaacattaagccggttatgggtgcaaaacccgagggcatcatctgccagctgggacaggcaaggggcatgaaaagggcgctggcaaaaatggcggatcacataatcgaagatctggagatgccggaggataagatactggcgatttcccactgtaactgtgaggagagggcgctggaagtacagcggatgcttttagagaagattcatgtcaagtccagcttcattatagatacggccgggatcagcacaatgtatgcaagcgacggtggaattatagttgtgatatagaaaagtttgtgataaaatgctgttaggcagtgagaacggataatgttctcaaaaagatacacgaaggagtttaaagatgagccaggaaaaagtagatagatacaaacaagaaaaagccaacaggaagaaaatagttaaaaagcagagaatcatgaatgttgtgcgcaaaacagtgctcagcttagcagtaatagctttagtcggatggctgggatactcggcataccagacacatgaagcggggaaagaaagacctgtagctcaggtaaactatgactccatcaataattatatgagccagttgagtcaatagcgggggaagcgcgaaatgtggggccgcctgaacggcaaggtgtgtatgccttttgcaggggcggtatatgtatcaagatttgctaaaatgaaaaagacgaaaaagcagggcaacctcggcaggccgtccgaaattctgatgaatttcgtacgtccggccgaggcaaaaccgtgatccggaatcacggttttgaccctgctttttcgtctttttcatttaagcaaatctaagatgcatatacagcccctgcaaaaggcatacacaccttgccgctcaggctgggtgcatcatagcggatttgtccgctggggattacttaactgggcctcgtggacggtgacgaaagggggacggggatgggatccgtttgaaactccctccatctgtccccactcgaattaattccccaccagccaccacgaattgaagaacatctccacctgcctccactcagattgattcccccacaggcccccacctaaacataatttcccccacttctctccattgcacaaaaatcccctatcatctaatatccaccccaccaatgtcaatcaatcctctccccaaagcgcaagcgtaaacctccgcccagccccgcgccccagccattcccgccaattccccaaaggggaagcggcagttgtcagtttccggatgaacacagccgggaaaagcgggaatatgggggccaggggcgtctttgcgggagttagccggacttaaagaaaaaaggcggaaaaccgggacaaaaactgtgatcacaaatcatagtttttccttgactctgagatcaaaatcatcagattttgggctcagtgtcaaggttgtcctggttttccgtcttttttcttttagtccggcttacccccgcataccgccccaggcccccatattcccgcttttcccgacggactcacccaacctccactccccctcccaagaatttttttgaaaaaaggacttgaaaatggaggaagagtggtttacaatggtgacaagtggtaggaagtggtagtgagtggcacaaagtggggaggaatgtggaggcccacttagcagaaggggttccggatgttattaggagagtttaatcatacaattgatgaaaaaggccgactaatcatcccagccaagttacgagacgatttgggagatagtttcgtaatttgtaatggcttggagggctgcctttttgtctactccatggacgaatggaacaaattcgttgccgaactggaaaccttaccacgcatgagtaaagatgccagagtattcaagcgttatttcttcggaagtgcatcagaaggcagttttgataagcagggaagggtacttgtacctccgacgcttaggaaagcagccggactggaaaaagatgttgtcctcgtgggagttcaggaccgcgttgaaatctgggataaggcactttgggaagagcggagcatggtcagcgaagaggatctggatgccattgcagaaagaatggaagcaattgggatcagaatctaaaagtgatggctgctcttttgacaaatggaggaatttatggcattcaggcacacatcagttttacttgaggaaactgtagacggtctggcggtaaagccggacgggatttacgttgacgctacactcggcgggggcggacatgcctttgaagtgtgcagcaaattaagcagcaaggggagttttataggaatagaccaggacgcggcggcgattgaagcggccggcgcccgattactcgacttcggggagagagttacaataatcaggagcaattattgtgatatgaagccgaggctccatgagataggcattgacaaggtcgatggaattgttctggatctgggcgtatcatcttaccaactggatacggcagaacggggattttcctatcggacagatgcacctttggacatgaggatggatcagaggcagaagatgacggcaaaggatattgtcaatgactacagcgaatcggacctctaccgcgtgattcgggattacggggaagacaggtttgcaaagaatattgcaaagcatattgtaatcgcacgcgggaagggcccgatcgaaactacaggacagttgaatgagattatcagacaggccatcccgatgaagatccaaaagacttcgggacatccctccaagaggacatatcaggccatcaggattgaactaaaccgtgagcttgatgtacttcgggatacgctggacgacatgattgatctattgaatccgggcggaaggatttgtatcataactttccattcactggaggaccggattgtcaagagtgcgtttcggaagaatgagaatccatgtacctgtccgagccatttcccggtatgtgtctgtggaaatgtatcaaaaggaaaagtaattacaagaaaaccaattctgccgagtgaggaagaactggaagaaaacagccgttccaagagcgcaaaactgcggatatttgaacggagcctgtacatcccatcaggaagtagggagcctgatgagggttaagcttccgattgtggggaagctgcatttattaaggagtatagcaaatagagctccgtcaggaaggggagagcctggcggaacagtatcaaggaaaggggcagacgaatatggctgcaagaagacaagttaccgcatacagaagatcagacagcatgaatagcagccatagacaggcatatgtttatgggaatacagtacgccagccggaagtcctgccaaagagaatgccggaggagcggcctcagcgtccggaaaggacaagccgccaagtgcgaaaaaaccggaaaagagcaatgaatatgagccccgcttatgcggtatttctggtagcagcagcagtctgtgcagtttttatatgcgttgcatatctgaaactgcagtcagacattgtaaacaggtcagagaatatttcagcgctgcaggagaagcttgcagacctgacagacgagaatgatacggcgtataacgcagcggcggactccgtaaatctggaggagatacgcagcaaagccatgaatgagatgggaatggtatatgcggcgcagggcaatgtagtggagtatgagagccctacaagcgattatgtaaagcagtacaatgacataccatctgacggtgttctggcgaaatccagagacgtatcagattaaggataacaactatggcaaaacgtaaaagaaaaaaccgatttcaatttttaactaaaaaatttccgaagaggatgcaaaaaaagctggtaatgctgttcatggcaatcatactggcttttattgttcttgtagggagaattacttatattaatgcctctaaggggaataaatataccaagattgtacttgaccagcaggagtatgacagcagagtaatcccttataaacggggagatattgtggaccgcaacggtaccaagatcgctaccagcgagagagtatacaatgtcatcctggatgtaaatgtgatggtatcggacgatgattatatagaacccaccattaaagtgctggaagactgttttggaatcaaggaatcagagatccggacccttataaaggaaaagccggaaagcaggtatgaaatactggcaaagggcgtatcctacgagaaggcaaaggaattcgaggcgatcgaggaagataagaaaaagaatccgaatgtcaagggaatctggctggaagacgattataaccggtcatatccttacaactccctggccagtgatgtggtaggatttaccgtatccggtaatcagggcgcggtcggaattgagagcgcatacaatgcgattctgaacgggaccgatggccgtgaatatggatactttgacagtaaatccacggtagagcgcacggtgaagccggcaaagaatggcagcacggtcgtatccactattgatatgacgctgcagagtattgtggaacagagtattagagaattcaacgaggcacataccggacaggagcgggaaggggaacccggaagtaagaatacagcagtcataatcatgaaccccaatacaggggagattctggccgaggcatcttatccgaattttgacctgaataatcccagagacctgacgggattatattctgaagagcagctgaaagaaatgtcggatgatgaacagcttgaagcaatgaatgcgctgtggaggaatttctgcgtcagcgatgcgtttgagcccggttccacggcaaagccttttacggttgcggcaggactggaaacgggagcgttaaagggggatgagaactatgtctgcggcggctatctgcatgtcggagattatgatatccattgccatctccggacgggtcatgggccggaaacagtagaacaggcagtggcaaattcctgcaatgtggcactgatgcagatggctgagtccataggaatcaaggattttaccaggtatcagcatattttcggattcggtgaatataccgggatagacctgccaggagaagcctctacgtcacctcttgtctatacggaagagacaatgggaattacagaccttgccaccaattcctttgggcagggatttaatgtgaccatgacgcagatggcggcagcattttcctctctggtcaacggagggtattactatgaaccccatgtagtaaaacagattcaggatgaaagcggaaaagtcattgagaccaaggatccggtacttcttagaaagacagtttcttcggaaacatcgaccacggtcaaacaatatatgaaggcggttatgactaccggaacaggtcagggcgccgcagtggagggctatgatatcggaggaaaaaccggtactgccgagaaactaccgcgtgatcagggaaagtatctgctatccttcatagggtacgctccgcaggagaatccggaggtcgttgtatatgtggtcatagacgagccaaacgtaccggatcagtccaccagcacctatgttctggagctgtcaaacaaaattatggcgcaggcatttccttatcttggtattacaacaatggaggggtatactgcagctacggtaggaaccgtacaggagggcacacagccccagcagacggagtacgagaattttgattctgcctatgaggatacttatgataatgcagacggctcctatatagatgaaaattacaatccggacctggatgactgggcggccggtcagccaacggaatagaatacgcataaccttacaaaagatgtaatatgttataaaaatgtcttttgtaaggttatttatttatgaagaacaaaacatataataaaaggaagatacttgtcgtattctgctgtgcatccgtcattttgctggcactgatcggccgccttgtatatctcatggtattcgacgcagaatactaccagaaaaaagcggaatcacttcacgaaagagagcgggagatcaaagcggccaggggagaaatcgtggacagaaatgggacagtgcttgccacaaataagacggtctgtacgatttccgtaatacacaatcagatagaagatccggaactggtaatccagacgctgatgaaagagctggagctggatgaggagactgtgcgcaaaagggttgaaaaagtttcttcgatggaaaaagtaaaaacaaatgtggccaaagaagtgggggacagaatccgcaattataatctggccggcgttaaggtggacgaagattttaagcgttattacccctacgatgagattgcctcaaaggtgctgggatttacaggcggtgataaccagggaattatcgggctggaagtgaagtatgaagagtacctcaaaggaataaatgggacgatcctgactgtgacggatgcgaggggaatcgaactggagggaatcgcggaggaccggatcgaacctgtggcgggaaatacactgcagataagcctggattacaatattcagtctttctgtgagcaggcggccctgaaggtaaaagaagaaaaacaggcggacagcgtttccgtgttgatgatgaatccccagaacggtgaaatactggcaatggtaaatgttccggaatttaatctgaacgagccgtatatactaaatacagggacagatatggacacgttgacggacgaacagaaacaggaagagctcaaccgtatgtggagaaatggatgcatcaacgacacatatgaaccaggttctgtatttaagataattacggcttctgcatgtctcgaggaaggcgttgtcagtcttagtgataacttctcatgccctggttacagagtcgtggaggacagaaagatacgctgtcataaggtgggaggccatggcgccgagacctttgtacaggggatacagaactcctgcaaccctgtatttatcgatatcgggctcaggctcggttccgataaattctatgattattttaaacagttcggcctccttagcctgacaaatgttgacctgccgggagaggctggaaccattatgcataagaaggaagatatcggtacggtggaactggccacaatctcctttgggcagtcattccaggttacgccgattcagctggcgacaacagtcagttcccttgtaaacggcggcaggagggtaacaccgcacttagggatggcagtactggataaagaggggaatgagatcgaaaaattaaagtataaagagaagaaggggattgtgtctgaggagacttccgcaaccatgaggatgcttctggaaagcgttgtatcagaaggatcaggtaagaatgcctatatcgaaggctataccatcggcggcaagactgcgacatcacagacactgcccagaagcgctaataagtatatttcatcttttttaggattcgcgcctgcagaaaatccacaagtgctctgcatggtactgatcaataacccgcagggcgtgtattatggaggaacaatcgccgcaccggtggtacgcagcatttacgataatgtcctgccgtacctagggatagaaaaaaaggaaatcgcacaggatgaggcagaaaagaacggtacaggggaagaggatatggcggattaagcagaaaaatgaaggagttctgtgaggggacaagagagagttttggttgaaaaaaagcagccaatgaggtatactgaatgaggtgttctgctgcgggccgggaggacacgaaagtagttagaatatggagcgaatttccgttaacaaaagagatgaagaggtgtgtgtatgagttatcatttagcgattccggtattgatttcatttgtattgagtttactcatgggaccagtggtaataccgtttcttagaaaactgaagatggggcagaccgagagaacggacggcgtacagtctcatttgaaaaaagcaggtaccccgacgatgggcggtgtcattatccttggcagcgtgatcattacctccctgttttatgtgaaggattatcccaatatcattccgattttgtttttaaccataggctttggactgattggatttttggatgactatctgaaagtggtaatgaaacggtccgatgggctgtatccgaaacaaaagatggcgcttcagattgtggtgaccgcaatctttgcctactatattataaaggtcgcaaagattccgcttacgctgctgcttccgttttcgggcggcaggtactgggatatcggctgggtcgcgatcccgcttatgtttattgcggtgattggaaccgtaaacggcacaaattttacggacggcctggatggcctggcttccagtgtaaccgtgctggtagcgacattttttaccgttgtggcaattggaacgaagagcggggtggaaccgattacctgtgcggtagtgggagcactgcttggattccttctatttaatgtatatcctgccagcgtgttcatgggagatacgggttctctggcactgggaggttttgtcattggaacggcatatatgatgcagatgccgctgtttgttatcatcgtaggcctgatttatcttatagaagtggcttcggtcatgatccaggtcacctattttaaaaagacgggcggaaaaagattctttaaaatggcgccgatccatcatcactttgaattgtgcggatggtctgagacgagggtggttgccgtattctccattgtgacggcgatcctgtgtctgatcgggctgatgggggtataaatcatggacttaaaagaaaaaaatgtactggtgttcggctcagggatcagcggagtggcggcaagccgtctgcttctgaaaaagggcgccaacgtgatcctttatgacggcaacgcgtctctggacgagaagcggataagggaagaaatcctggatggtataaaaggcagcgttaaaatgatacttggggagcttccggaagaggttctggagacactggatctcatcgttatgagtccgggcgtgccaacggatcttcctgttgtagaccggatgagagaaaagaatattcctgtatggggcgagattgagctggcctatgtttcagggaagggtgatgtgcttgccataaccggtaccaatggaaagacgaccaccacagcgcttctcggggaaatcatgaaaaattacagggacagcacttttgtggtggggaatataggaaacccttatacagatattgttctggacaccagggcagattcggtgattgtggcagagatgagcagttttcagttggagagcatacataccttccgtccgaaagtaagtgctgttctcaatattacgccggatcatctcaaccggcaccacacgatggatgcctatattgcagcaaaactgaatgtagcgagaaaccagaccggggaagatacatgtgttctgaactatgaggacgaggtgacaagaggttttgcggaaaaagtgaacgcaaaggttctatatttcagcagccagcgtaaactagagaagggaatatatctggaagatggcagcattgtctgcagtatagatgggacaccggcggcggtatgccatatagatgaattgaagcttctgggcacacataatcatgagaatgtaatggctgcggcagctatggctgcggcgtatggagtgccgatggagattattcggaagaccgtgaaggaattcccaggggtagagcatcggatcgagttcgttgcggaaaagaacggtgttgcatactataacgattccaagggaaccaatccggacgctgctattaaaggtattcaggcgatgaagcgccccacactgctgattgggggcggatatgacaaggaatcctcctatgatgaatggattcaggcctttggcggcaaagtaaaaaaacttgtgctgctgggagcgacaagagaaaagattaaggagactgcagaacgtcttggtttctgcgatatcattcttgcagatacctttgaggaggcagtggaaacctgcgtaaaatatgcgctgcccggtgacgctgtacttctgtcgcctgcatgcgcaagttggggaatgtttaagaattatgaagaacgtggagataaattcaaagaacttgtaaatcagttataaggagtgaatttatattggagcgtcctgctaaaaagaagcggtatgattatacactgctaattgttgtgttacttctggtgatcatagggctggttcttctgtacagcaccagtgcctataatgggcgggtaaaattccacgattctttttattacctgaaaaaacagggatttgcaactgcactgggattggttggcatgatgatcgtggcgaaaattgactatcacaaatgggtacccctggcaggcctgggctacctgacggcgatactgttatcggttgcagttatgtttataggagacgagtacaatgggtccaaaagatggctgtctttagggcctgtttcatttcagccgtcggaatttgcgaaggttgccgtcattttgtttttggcctgcctggttacgaaaaatgcaaagaaaatggggaaacttacgacgctcataaaggtaatggtcccagtcctccccgtagtagggctggttggagccagcaacctcagtactgcgattattattatgggaattgcagcggtactgatcttcgtggcaagccctaaatacgcgcagtttgtctggatgatcgtggccgccggtggatttatgggtatctttctggcattggaaagctaccgtctggaacggctggccatctggaggaatccggagctttatgaaaagggttatcaaaccctgcagggcctgtatgccatcggttcaggcggtctgttcggcaggggcctgggtgaaagcgtacaaaaactgggatttctgcctgaagcacagaacgacatgatattttccattatatgcgaggaactgggccttgtgggggcaagcctgattattctgcttttcctgattctgatctggcgtttttttgtcatagcaacccgcgccaaggatctgatgggggccctgattgccgccggcgcaatggcgcatatgatgattcaggtgatcctgaatatagcagttgtaacgaattcgataccgaatactggaataacgcttccctttatcagctacggaggcacatccgttatgttcctgcttttggaaatggggcttgtgctgagtgtttccaatctgatagaatagggcagagaatacaaagcaactcaaagggcatcccgtaacacatgcccttacgggcgggtctgcggtaaaccgcagattatggtaaggaggacgacagatgaaacgtaaaaaaaagagcagacgtgaaagatatgaagaatacgatgacgaggcatatataaacgaagtattatataaggaaggataccgtccgccggagcgtaaaaagaaaaaacggcggggagtatttcttggactgctgacatttattcttggtattgtgattattgtatttgcctttctgcttctttttcatatacaaaagatcgaggtcaaaggtaacaagtactgcacggaaaatgatgtcatcggctggctcagggaagacaagtatgccgtgaattcggtttacgtctggtggaagtataataaggcagatgtgaaacagctgccggtggtagagtcctcaaagatctcgttcagggccccctgggccatacgggttaccgtgaaagaaaaggagataagcggttatattgactataacaaccagtacctttactttgacaaagacggtacggctgtgctgtccactgcggagaagatagattcggcggcttatatagagggcatggaagtggatgcttctaaggtgaagctgggcaaggttctgccggtttccgataagaatgtatttaagcgtattgtggagatctctcagctgctggtaaagtatgagctctcgccggaccggattacctgctcgggaagcgacctgaacctgtattttggcaatgttgaggtgttgctgggcaagactaattacgaagtacggctcgcgcaggtgccgccgattctgcagaaactgacagaacagtatccggacaagcagggcaccctgcatctggaaaattatgatgccgctgacaaggcggtacgtttcgtgccaaaagaagcccaggaaggtgcacagacagatgaacaggacgacgggcaggcgccggaagggcaggaagagggacaggatgacggacagaatgcagcggaaccacaggattcacagaaccaggattcggctccggaaacagaagatcctcaggagccataggggacagaatcggccagggagtaaggaaggggcgctgaactgcggtaccggcaacgtggaagatgtttccagaaccccgtaaaaaaagccttccaggagcctggcaaaagaaaattaaaggcccgtgaattgaataaaaaaatcagaaaatacacaaatatctattgattatttaccgaaaagactatattatatacttattgaattatatcgttcaagcataagggatgtataaaataatattaataggacgacaaaggaggaaatactcttgttagaaattaaaaccaacgaatcagaagcagctgcaagaatcattgttatcggagtcggcggcggcgggaataacgcagtaaaccgcatgatcgatgagcagattgcaggtgtcgaatttatagcgattaatacagataaacaggcactccagttatgtaaagcaccaactttaatgcagataggcgagaagctcacaaaggggctcggtgctggtgcgcagcccgaagtaggggagaaggctgcagaggagagctcagaagagatatctgccgcactgaaaggcgctgacatggtattcgtaacatgtggtatgggcggcggaacaggaacaggagcaactccggtcgttgcacgtatcgcaaaagaacagggcgcactgacggtaggtgttgttacaaagcccttccgttttgaatcgaagacccgtatggccaacgcccttgcggggattgacaagttaaaagagaacgtggatacgctgattgtcattccgaatgacaagctgcttgaagtagtggacagaagaactacaatgccggaagccctgaagaaggcggacgaagtgctgcagcagggtattcagggtattaccgacctgatcaatgtgccatcactgatcaacctggacttcgcggatattcagaccgtcatgaaggacaaaggtatcgcacatatcggtatcggtgcgggccgcggagacgacaaggcactggaggctgtaaagcaggctgttgccagtccgctcctggagacaaccatccagggagcgtcccacgttattatcaatatttcaggagatattacgctcatggatgcatccgatgctgctgagtacgttcaggaactcgcaggagagaacgcaaatatcatcttcggtgctatgtatgatgattccagatccgatgaggcaacaattactgttatcgcaaccggcttacataacgtaggcggcagctcttccaagttaaaagcaagactggaaggacagcagaaggtgggatcgattcttccgtcaggcgatgtggtaagcagaagcgctattgatccggagcgcagaacagcatctccgagaccggcgggcagaccggcaggcggcacaatgccgaccctggatcagccgagaacaccgtccagcaaagtaaaagagcagtccattaagattccggatttctttaagaaataaaaccggacaggctgattacaataagaaaaaacaggcaggagccccgcggagctcctgcctgttctttctacaggaaattctcagggaaacctctgcggaaacctacctcattggagtttaacatttttttagcggctcgtactgccctgttactcaccgtgacagttcaaacaggcacaggagtctattagattcttgtgagattgtcgaaacaatttctttttttcccgtcagtatctgacaaaatttcagtgacatgcaatatataataagtcttgcttgagtgccaaatcgatttagtaccaacgagaaagagggtggaacatgtactatgaattatacatagacgtgttgtttcttgtaaattttatgatggattcccttctgcttttgtcagtgaaccaggtgctgaaatgtcctaccacacgtggacgcatatttctgggcggagcattgggggcattactgacatgcgtagtaacagttgtaccgatgccgggtgtcataaaattaatcatattccacgcggttatcaatacatttatgataaaaacaggattaaagatcaaaggaaaaaagcaattttggaaagcatttggtttattgtatatcgcagcatttctgtacggggggattctgcaggcatttcatccctatgcgcgcgcgggaagcctgttttttgcgacagccgtgggcagctattatctgatacggggaatctggaaattcctgatcagactgcggactctgcaggcaaagatatgtgagattacgctgtataccagtgcaggcgaacagaaagtaaaagcgttaattgacacgggaaacggtttggaggacagtgtgtcgaaagaaccggtaagtgtagtagataaagctctggcaaaatccattctgacagatgacgacatgaaaaacggtttccattacataccataccgtacagtcggaaaggaaagtattatgccggttttcagaattcggaaaatgtgtattcatctggagggagaacggtggatcgagaggccggtcataggcgtttgcgaagagcatgtttcagaagaagaggaatatcagatgattttaaatcctgacttattaggaggcatataaaatggttgtaaaagtagcagtaccccagcagtttaaactgaaagtaataccagacatcagaagcattttcttccctaaccacaaagaaatacattatattggaggatccgaggtgctgccggccccgctggagacagaacgggaaacagaggtgatagaacatctcggttccgagtatgaccaggaagccaaaaagcttctgatcgagcacaaccttcgtctggtcgtttacatagctaaaaagttcgacaatacaggagtcggagtggaagatctgatttccatagggacgatcggtctgattaaggccatcaatacatttaaccctacgaagaaaatcaagctggccacctacgcatccaggtgcattgaaaatgagatcctcatgtacctgcgcagaaacagcaaaaccaagatggaggtatccatagatgagcctcttaacgtagattgggacggtaatgaacttctgctgtcggacattctcggtacggacgaggataccatatataaggatctggaaaacgaggcggaaagaaaacttctaatcaaggccatcaataagctgtccagcagggaaaagctgatcgtaaaaatgcgttttggactcgataacccggaaggcgaggaaaagacacagaaagaggtggcagatctgcttggaatatcacagtcctatatctcacggcttgagaaaaaaatcatgcagcgactgaaacgcgagatggtgcggtatgaataaaagccggcaggatgaggttggcgttccgccgcaggggatacaaatgtggtcatctgccgtgcttcagggaaatggggaagcggctaaataaaatttcaggtgaaatagcggacagcgtagacaccaggagctgtcgggagatgaaatccatatacgagatattgttgcagaccatatgtctaaacagcaatatatagtatatataattcattttccgatcccccctgcgggtctgctcattttccgaacttgtggttcagaaaatggtccgtatttcacctgaaattttattgaagccgcttatcccatattcctgaacgcccggcagatgaccaaattcgtatcccctgcggctgcttgcatccaggcggggcttttattttgggaagccttaccaggaggagaggcggatgtggaatgggagattggtgtagtgtccgagcgggacaggcaatctggtgtgacagctattgatgccgcgtgttattttggagggggacggagctgggggatgtgcaaattttactggtattgcttgattttttagcgtaatatgtataatatttaagtatatggacctgcaagtgtactttggtggatttatttgtgtaaaattgacaaaacattttcgcgggattattgttttccggcgatatacacaaaaaaagtagccgaaagtagtatggtgaaaaactagatattcgtttattattaagttagttagaaacgtattaacattttcaaaaggaggtagacgaatgtctagaaagatcaaacttaattacacaaagagggatgatttaacaccgagattgaaagcggcaaaggaaaaattatttgctacagagccacacattgatactcgtaaacttattatcgagactgatatttatcagaaatacggctttacgaagagcccgaacatgctgaaagctatggtatttgatcgcttaagccgcgagaaaaaggtatggattgatgacaatccgatctgtggacatctgacagactatacatacggaagttatttccagccgttcagagagtttgagtgggcaatcgaccgcgatgaatttgctttccagagaggttcagctatcgcaacagaagaagaaaaagagatcatcagaaaatgtggtgagttctgggtaggaaatgcagttaaagaccgtgttcgtccgatcattaaggatcgttacggacttgatgttcaggaactgattgatgttggtgtaggccttaactttgacgatgatatgggtacaacaacattcccggatcacgatactgttatcaacgaaggtttgaattcaattattgcaaaatgtaaagactatcagtcaagattgaaaatatggaatgttgaccgtccggatccattagctggtgaagttcctgatgaaaacacattcaatgaatcaacgattccgatgcctgactataagaaatgggaattctacgaggcttgtattatttcttgtgaagctttgatccatcaggcacatcgttatgcagacgcagcaagagaagcagcagcagttgaaactgatcctgcacgtaaggctgagttagaagaaatggctgagacatgcgattgggtaccaggcaatcctgcacgtacattcaaagaagcaatccaggcactgtggttcattaccatgggcggatggcagaacctgtgtatgacagttgaccatgcaccgcttcgttttccacagtatatgtatcgctgctatagagatgatattgatgctggacgtatcacagacgacgaagttatcgacttaatccagttctggttcctgaaagttaatacacagaacttcgttatgtcacctgagcttgctctgtggaactcaagccgtatcgctcagcagctgaccatcggcggacttgatccgaagactggtgaagacgctacaaatgaacttgattatctggttgtagaagcacagcgccgtgcacagtgtccggaaccgcttctcgcttgtatgtatcataataaattatcacacaggttccttgttaaatgtgctgaacttgttgcaacaggtattggacagccatcattccatggccaggaagttgctatgaaacgtcgtctgctccatgagcacggcccaatcgaagatatccgtaaccaggctgtttcaggttgtgtacagtccgttattccaggctatacggatggcgcatgggaagctcgtttcaatatgtacaaaccgcttgaattcatgctttcaaatggtgttgacttcaagagcggcaaacgcattggaccagcttacggtgatccttgcgagtgcgagacatgggatgacttctatgctcagctgctcaaatattatgaatactgggagatcatctgccgcgacatttctacattagagtggaacgttatgagagacttcccgtgtccgctgctttccgcagttacatatgactgccttgcaagaggtatggacgttgtagacggtggcgctagatacaactggggtgatggaatctgtatctctggtaatgttgatacaacaaactgtctggcagcaattaagaaactcgtttatgatgacaaaacaatcaccatgaaacagcttgttgaagcagttgcagctaactgggaaggatatgaagatatccagagcatgtgtaagaaagctccgaagtatggcaacgatattgattatgtagattcgcttggacgtcagttacatgctgatttcgctgaaatccataaccgcagacctgactacatggggcgtccgacaattacaccttctgcatactcagtaacaggacattatccgtttggtatgagaagctgggcttcaccggatggaagaaaagcaggcgagacatttacggatgctacactttccgctacacctggaacagatacaagtggaccgacagcagttatccactctgcagttaaactgattgacccggtagtttatggatctactcactttaacatgaagttccacccaacagccctgaccggtaaagagaatatcgacaaattcctgactcttctgaagacatacttcgatgaaggcggataccagatacagttcaactgtgtaacacaggaaaaactgttggcagcaaaggcaaatccggaagagaacaaagacctcatcgtacgtgttgcaggattcagtgcttacttcgtaacactggcagatgctgtacaggatgagattattgcacgtaccagccagacatggtaatgctttgattacaatgtttgagtaaataatagggagagagattatgagtgatttaacagcccttgtatttaatatccagggattttctatccaggacggtcctggtgtaaggacaaccgtatttttaaagggatgcccgctgagctgtcaatggtgtgcaaatccggagtcacaggtttttagatccgatattatccatgtccctagcacttgtgtacattgttatcgttgtgtaaacttttgcaccaaaggtgcggttaagctgccggagaagatgggggataacccaatctttgatcacgatgtctgcgttacatgcgaagatcaagacgtttgtgaacattcctgctatgaaggagcacttgagaaagtcggtaaaccgatgactgttgatgaggtaatggatgtaatcttacatgatgaaccattctttgttaatggaggaggtattaccgtctccggtggcgaacctttgatgcatccagaatttctagaagaactttttagtgaatgtcaggacaattatatccatacagctatagagacatgtggatatgtggcatgggataaatttgaacctgtattaagatatacggatctggctctctatgatgtgaagcatatggatccggtagcccacaaggaactgacaggagtatccaatgaattgattctggataatcttcgtaaaattatggatgagacgaatacagaagtaatcattcgcatcccggttattccgggtgcgaatgatacaaacgaaaacatggacgcgactgctaggtatgcgaaagagataggtgccagagagattcatatcctgccctatcaccgtatgggaatgggcaagtacacaggtctcggacgggaatatccattgggagaagaggtggaatccccatcagatgagcgtatggaggttatccgtgacatttttaggtcttatggcctgatttgtaagataggcggaactgaaaagggggactcctaataatgagtaaagtaaagtttttgggcaagccaatgagtattaagcgcttgctgacctatgtgattggtttgtggattatgagtctcggtattgcatttgccgtaaattctaattttggtgtttcaccagtcacaacgttgccttatgtagtcggcagaatcctgaatatcagcgttggtacaggaacatggattgcatatggatgctatattatcattgaagcaatagtttatcgtaaggaatttaaagctgtttatattctgcagttcccggcagctgttatgtttgggtattttacagacttcagtaagtggttgatttctccgcttggaacaccggataaatggtatatccagttagtattcgtaattgttggtgttattatccttggattaggattgatggcatatttggaagcagatattatggctattccgcctgatgctttggcggttgcatttgcttggctggttaagaaacctttgggcaatgtaaagagaatttttgatttatgtattgttgcaacgtcgttgattctttctttagtatttctgcacagctatcagggcatttggattggaacaattatcgcagctctgggtgtaggaacgatgcttaatttctggagaaaaatactccttagtaagataaaagtattcttatggggaaaacagccggtagctgaaccaaaattagacgaagcaccggcggcagcaaaataatttaaaaatggcagtgaggggttatcacttgggggagagattttccgccactgaggtagccccccacgtgttggatgagatgtgacttctatttaatctggatttaatgggagagaggaacgtgtatgtttttaattgcacataatcagataatgttaccaaagcgttattttagcgatattgtgccggcagttgaagaactgtcaagcacggtaggtgctgtatttctcaataaactgattttagatgaaagtaatagaccagttgagtttaatcaggcgattttttccgagaaaccactaacccgtatcgttacgatgcattttcagaatggagatatgttcgatcagttctgggatgcaagagaacgacaggatttatggcttattgggaaaaattatgcctatttttgtgatacgatcatggaaaccggcagcacagaagcatcgagaattattaagccaataccagaaaaagaatcagacatggaaatattaaaaggacatggacttacggaacgcgaggcggaagttatgtattggctctgccagggcaagagtaatggtgatattgcctacatactgaatctgagtgttagtacagtcaaaaaacaactttctaatatatttgacagcatgggagtacgaagccggtctgcagcagtggcactagcactggaaatggttggttctcagaaatccaaaattcatcttgtattttaaagagatttcgaaaaggaggacagtgtatgattaagataaccaaagaagggaagaagatgttggagacaacttttggatccaaaggacagacaaaatttaaaatccagcatatcaaacctacttgcaatgcatgccgggatgagcttcgacttgttcctggttcgtcggaaccgaacgatgtgatttcgatggaatccgggtatgttttttttgttgacaaagatcttatgcagcttgcggagattataacaatagatgcggcgggggatataccagttctgacaactcgcaaatctattgatcttcgtgaaagaaatttttaattttggaggattagttatggaaaaaaaggaattaaatcaaaagatactgaagtttataagtgaggcaggtttcttcttctttgctacaacggaagatggaatgccaagggttcggcctcttgcatacattgaggagataaaagatgagctgattattgcgatcagtacaacaaaggccatggcgaagcagatagatgccaaacctgattttgagatttgcgccagcacaccggagacatggctgcgtattaaggggacagcacagtcggtgactgacaaagacgtcattgcgaaggctatggaatgcccagttgtaaaagcaacttatacggaagagactgttggggcacgttacctggttcttgacagtgtggaatatttttctctgacgggtgaatacagccgctggaaatgatttcggaaaggaagtcttctaaatggcaaaagaagtgaacaaggaagtatttgaggtacttcctgtaccgcaggcagtggctaaatttgttcttccttcgcttgccagtacactcattacaattatctacagcctggcggacacactttttgtcggtatgttaaataatccttcgcagctcgcaggacttacagtggcatttccgtactatcagttcctgaatgcgttctcaagcctttggggagttggtacgaacagcgtcatgtcacgtgcgcttggagaaaaggactatgaccgggtatcaaaagcctcttctcatgggttctggggcagccttgtatttatggctgtgatatgcgtcatattccaaatactggagaaaccgcttctttacgtggcaggagccagcgcacagtcttatgattcggcatctgtatacatgctgatcgtgtttgttataggcggcattcctactgtactttctatcgttatgagcaatcttctgcgtgcagaaggacatgcaaagtcagcaagcagcgggcttatgctgggaggcctgttaaactgtatccttgatccgatctttatcttcggagcagatatgggagttgcaggtgcggctgtggccacactgatttctaactgtgtatcgctgattttcctgatcattgtttatatccggatacgtgagacttcttatataacattgaaaccattcccgggtggtgtgtcctggaagctgataaaagatgtgatactggttgggctgccgtcaggctgtttgaccgtactcggtgctacaggatgtatcatacagacctcactttattctttgtatggcgatgcagcagtagcaggctggggcgttgttaatcgtatcagttttatttccatttatacagttcatggcgtagcacagggagtactgcctctgatcggttacaattacggagccaagaactttaagcgtgtacggagtgttaacaaatgtgcgttccttatcacggaagtacttgcttgggcaattatgatactttctctgatattcagcgcaggtatcattaagatattcatcaatgatgtagcaacaatagaggctggtgtccagattatgcgtaaatatatgctctgtacaccgtttatggcaattgtactgctggtaagtacactctgccaggccgtggggaaatggcaatattcactgattatgctcgcgattcggcagcttgtattcaatattccgatcacattccttttaaattctctttttgctatgaagggtgtggcaagcggccagccaactacagagttaatttgttttatcggagcattgttcgtatatcatagatgtttctatcgagctatgaacagagaggaattgctaagtaaaaagtaagctgaatatatagcttatgatataaagggaggaagaaggatggtaattaaagagatacttgaaaaatctgatgcattatttgccgaaggaaaacaccaggaggcggcagcatttcttgaaggaaaggctgttctggcacagaatcaggatgaatggaaggtggagctttccatcatcaatgaattgatggggtattaccgcggcataagccagctcagtaaagcatgggactacgcattcagggcaatacagattaccgaagagaatgcggtaggagacagtgcagaaggaattactacttatctgaatgtagcgaatgtctatcgggctgccggcaagccaaaggaagcattatcactttatcagcaggtggaagagacttacagcaaacagggagtggaaaaagagtaccgtggaggcgccttatataataatatgtcagtggcatatttggagctcggaaaaagtgaagatgccgtgcggtattgtgaaaaagcgatcgacgtgctgaagacgattccggaagtttgggatgagtgtgcagctgcttacagcaatctggccggtgtgttattaagaagtgaagtgcctgatgttgcaaaggcggatgcatgtgtagacgaagcattgaagctttttgagggaaagggagatagtgctcattattgcagtgtattggccatgaaggcgtatattgcttatctgaagaaggatctgcaggaatcgctggacatgtacgagaaggcaatgaatgagacaatgaagtattatggtaaaaatgcagactatgagcgtctggagcggaattataagggcgttcaggctttgctgaacggagaaaaaaaatgatgagccagttgagcggattagaaggtgagatgaaaggcctggatttgtcacgggaatattatgaaaatgtcggcaaacccattttgatggaattatttcccgagtatatggaaaaagcggcggtcggtctagttggagaagggtcagagtgctttggttttgacgatcagatttccatggaccatgattatggaccgtctttttgtgtatggtttccaagaaatatatataccgaggtcagggagagcatgtccgagatctatgatgcacttccgaaagaatacaaaggtgtcagcgcaaacttgattagagagcagtctgcagggcgccggggaattctggagattgagggcttttatcaaaaatttctcacccgggatatagtcccggaaaacttgacagactggctcaggattccagagcattattttgctgtagcgacaaacggagaggtgttcgaggataatctgggcatgtttagtgaaatacgtgagaagcttctcaattattatcctgaagacatcaggctgaaaaagattgcagcctgtgcagtcaagatggcgcattccggacagtgcaattatgcacgtatgatgtggaggcacgatgttgtggcagcaaaatttgctctggacgaattcatgagaaatgccatatctctggtgtttcttctgaatcgtgtttattgtccatattataaatggatgtggagaggcatggaacaactgccaaagcttggcaaggtcaaagatcttttgaagaatatggcggctggggctttggacgttagtcactgggattcgggtaaatggaaagagtgccggtataaactgaacagggaagatccgatggttgatatggtggagcagatagcggatttggtaagagaagaactgtggagccaggggataagcagcagtacatcggactatctcgaggaacatgcctatgcagtgatgacccgtatccaggataagcggattcggtcattaccggtacttatggggtaaaaattatgagtaatataagagaaatagtcgaagaggaatggagacagtttcaaaaggtaaacaatcagggcggaagggcatcctgccaggatgactggaaaaccttctatatcatgagaaaaagtcagttccttgtttggccgcaggagatattggacagttattacgatgatttgtgcaaagcccgtgaagagggcaggaatctgttgtttgcaaagtatgcgtatatgatggaaagtacggcgcctgaagagtttgaaaaattaaaaaaagttctccccgtaatttctgatgagcggaaaatgcgcgtggatgaaacggttgctgcacatgtaaaatgggcggaagaatttgagcaggaacatcctgaatacgcacggcggggacgtcctatccgtgcatgtcaggaggcgccgggccaaacctctatagagacgtatcaaagaggggaattgtattcctacggtgaaaacacggaaaagctgtattctcaatatgttcaggagtgcgttgctcagaatagaaacctggcgtctcttattcgagagaacacaacacggatgtacgggtatgagtcaatttctgatatagaaaagagaatggaatagctgtcagctaaaggacgatgggaatgagggacaataggagcgggaagttagcagctatctatattctttatattatagtgtccgggataaccggtatcttatgtaggacaggatacaaggccatgattgggctgcttctgggatccgcagccgccttcgctaattacttcttattaaaattggcggtaggccggctgctgggtgtcaggaatatttttgttgtccagatatttcttttccgttacctgctttatatcgcagccgcgtacgtgtccatgagggccgggagggcggcagtgctgatgtatgcagcaggaatcttaggcttatcgctggctattttcatcgtatatggaataggaggagtaaaaaaacaatgataaacgtggaagaactcggcgcccggattatattgggcttcggagagggaaagctgtttatcacagagagtacattgtttggactcgtgattgccgtgatactggcggtgctggggatctggctcggaagcgggctgaagacggtgccgaaaggaaaacaggtggtggcggaatttatcgtgggctgggtgtataagtttacggagaacaacatggggaaggagaacaagtcctatgcgccctatgtagggagcatccttgggttcgtattctgtgcgagctgcctggggctgtttgggatccgtccgattacggcggacttaaatgtggcgtttgccctgtcagggctgacgttcctgatgatcctggccaactcactgagagtgcacggggtaaaggggaaactcaaagagatgtgcgacccgtacccgttcatgttcccgctgaagatcctggaggagtgtacattaccgatctccctggggctccggcttttcgggaatatcctgggagggttcatcgtaatcgaactgtggctgcatctgatgacgcacctaagcaacatgattacgacggtcccgtttctgcgtgcggttacggtactgccgctgaatgcgatctttgacatagcggaaccgttaatccaaacgtacatatttaccacgctgaccgtgataaacctcggtgcagcagtcaaaataatgtctgtgggacacagcgagtaaaggaaaaagaaagacagtaaatcagtacaggacggtgtatttacaggattgtctgtacgaaaatatcaaatatgcgaaagcaggccccactgcgaaaggcggcttatatgggcttgcagcgtatctgctgatggttttgaaaagattcaaagaaaaaataataggaattgattacaggaggaaatagatatgggaatggttgcactgggaatcgggatgtgtatgggattagcagcactgggcatcggcctggggcaggggctggcactgagcaaggggctggaaggcatgtcaaggcagccggaagtagcaggcaagatccagacaggtatgattgtaggtatggcaattatggagaccatcggtgtcctgaccttcgttatcgccattatgctgtcgggaaaggtataagagagaagggaggcagccggatttgaaagtacaattatatcaggatctgcttacaatcaactggaacctgcttttttcgctgatcaccgtggttgtgttagtgttaatcttaaaaaaattcttttttgagaaagtacaccagtttatggaggcaaggcagcagcaggtggtgaacacgctgcaggaagcccagacgacgcgcgaagaggcacagcagaagctggaagagtatgaggcgcagatggcgtttgcagagtccgagaaacgggagatcataaagaaggcaatgcaggaggcccaggcccaggcaggggcggtgcttgagaccgcaagcaaagaagcggggcaggtgcgggagcagacgcgccgtgaaatcgagcgggacaagatgattgcgaagaaagagctacaaagagagattggagacatggctgtccttgcagcagggaaaatcataggagaagaactgaacccgaaaagacaggcagaagtagtagaaaagattatagaagaagctgaggattcatcatggaaagaataacagaacagactgaggtaaagaaactgtgcgggcaaatagatacagtgactgaagaactggctgtgctgaaaagactccttatggaggaagagaactttttccagatgctgacgctgggtgaaatcgggaaggaaacaaggcttgagtggatgcgggacatatttgggagccatatcagcgatgagacgctggcgttcttctgcatcctgttagaccgccagggcctgtaccatttcagccaggtgctggccgaagggctggagcttctgggagaagaaagacaggggatccgtgggacggtatattcggtggtgccgctggagaaggaaatggtgaagcgcctggaagagcagacggcggaactgatcggcaagccggtgaccctggtaaacatgatcgatgaaggcctcatcggcggggtattgatctccgcagacgggaaactcattgatgcttccctgaagaagagaatggaagatttaagcttgaggcttcgaagcaggccggaaggggggagttctctatgatgtggaatacagaggagatcagcagccagatcaaaaagcagatagaaacctatacaagccagatggagatcacggattttggcaccgtgcaggaagtgggggacggggtagcccgtgtgacaggcctgcgccactgtgtggcgggggaactgctggagttttccggcgggatctacgggatggccatgaacctggaggaaaagaatgtaggggcggttatcatcggagcagaccggggcatcaaggagggggacattgtccgcccgacaggccgggtagcggaagtgcctgtgggggaagagctccttggccgtgtcgtgaacccgctgggtgagcccattgacgggaagggcccggtagagacggataagacgcggcccatcgagagcccggcgccgggggtgctgcagaggaagtcagtgcaccagccgctgcagacgggcatcaaggcgattgacgccatgatccccatcggaaaggggcagcgggaactgatcatcggggaccgccagacgggaaagacggccatcgccattgataccatcattaatcagaagggcaaggacgtgatctgcatctatgtggccatcggccagagaaagtcgaccatcgcgcagctggtgaagacgctggaagaccgggatgcgatgcgctataccatcatcgtgtcggcgacggccagcgacgtggcgccgctgcagtacatagcgccctatgcagggtgtgcgatgggggaggaattcatgtatgaagggaaagatgtcctgatcgtatatgacgacctgtccaaacacgcggtggcataccgtgccatgtccctgctgctgaggcgtccgccaggacgagaggcgtacccgggggatgtcttttacctgcacagccgtctgctggagcgctccgcgaagctctccgatgagctgggcgggggttccattacggcgctgccgatcatcgagacccaggcaggggacgtgtcggcgtatatcccgaccaacgtcatctccatcacggacggccagatcttcctggagtcggaactgttcttctcgggccagagacccgcggtaaacgccgggatctcggtgtcacgggtagggggcagcgcccagatcaaggccatgaagaaggtggcgggaacgatcaagctgatgctggcgcagtaccgggagctgaaagggttctcgcagtttgggtcagacattgacaaggataccaaagagcggctggagaacggcatgctcctgatggagatcctgaagcaggggcagtaccagccggttgcggtggaacaccaggtcatgatcatttatgcggcagtaaaagggcatctggcgggcattgcgccaagccaggtgaagcggtttgaaaaggaactgtaccagtacatggatacgaattacccccatgtggggaaagccattgcggatacagggaaactggaagcggagacagaggaacagcttttgaagggcatagaagaatgcaggaaggcgggtagattcgatggctgaccagatgcaggcgattaagcgcaggatgaaaagcgtcagcagcacggagaggatcaccaatgccatgaaactggtttccgcagcgaaactgaagcaggcaacgaaccggttcgactatatccggaaacacctggaggaggaaaagcggctttacgggcaggtcctgcgtaccgaggagggggtgccggaagtgtacctggaaccaagggacggggaaacgctgtacatcctgctcaccagcagcaaagggctgtgcgggagctacaatacctccatcacgaaggcggcggggcagatcgcagaggaagaaaaaggcagctgctgtttcgcggcccttgggacaaagggaaaagagttctgcatccgggaaggcctggagatgctggagacggagcgggagcagatggatgagatggggtacgaggaagcgtaccggctctcaggggaagtgctggagctgtaccgggaaggccgttttacaagcatccgggtgctgtatgcttcctacctgaactcgatttcccatgaggtgaaggcggccccggtgttcccgctggaggcagggggggcaggcaggggactgtgacctgaccctgatggaatacgaaccggccgggcgggagctgtttgacagcctggcgcaggagtacctggctttgtacctgtacagtgcaatcgcggaggcgaccttgtgcgagcattcggcgcgcaggattgcgatgaagaatgccagcgacagtgccaacgagatgctgacagaattatctatttactataacagagcgagacaggcggcgattaccagtgagatcattgagatcatcgccggctcggaggctcagaaattaagaggtgaggcaattgaataaaggaatcattcaacagattatcggaccggttattgatattaagtttgatgaggaacagatgccgaatcttcttaatgcaatacatatcgagcaaaacggaaagaccattgtagcagaggtggaacagcacattggtgcggatcaggcccggtgtattgccctttcatccacggatgggatgtaccgggggatggaagcgaccgacacgggggagccgatcaaggtcccggtcgggaaagaagtattagggcgcctgttcaatgtgctgggcgagacgattgacgagaagggcgccgtagaggcggagcgttacgatgcgatccaccgcccggcgccggactataaggaccaggacacgtcttctgtgatctttgagaccgggatcaaggtcattgacctgctggccccttacacaaaaggggggaaggtcggcctgttcgggggagcgggggtagggaagaccgtgctgatccaggagctgatcaacaacatcgccaaggaacacggcgggatctctgtgtttgcaggggtaggcgagcgtaccagggaagggaacgacctgtattatgagatgcaggaatccggggttatcgataagacggccatggtattcgggcagatgaatgagccgccgggagccaggatgcgcgtggcgctgacggggctgaccatggcggagcatttccgggacagggagcaccaggacgtgctgctgttcattgacaacattttccgtttcacccaggcggggtcggaagtatcggcgcttttggggcgcgtgccctctgcggtaggctaccagcccaccctggcaacggagatgggggcgctgcaggagcggatcacgtccacgagggacggttccatcacctcggtgcaggccgtatacgtgccggcggatgacctgacagacccggcgcctgcgacgacctttgcgcatctggatgcgaccacggtgctcagccgtgcgatcacggagctggggatttacccggcggtagacccgctggagtccacgtcccggatcatggacccgttaatcctgggggaggagcattaccagaccgcccgtggagtgcaggaggtgctgcagaaatataaggacctgcaggacatcatcgcgatcctggggatggaggagctgtcggaggaagataagctgacggtagcccgcgcaaggaagctgcagcggttcctgtcccagccgttctatgtggcggagcagtttacggggatggccgggaagtacgtgccgctgaaagaaaccatccggggctttaaagagatcctggaaggcaggcacgatgagattccggaatccatgttcctgtttgcaggagggattgacgacgtaacggagaagtacgcccaggggcagaccgcataagggaggcccggaagcggaccgtgtgcagaaggaggcttagggcggatggcagcaaaaagttttttattaaagattgtaaccccgcagcagttattctattccggggaagtggagatggtcgtggtagagcaagcctcggggcaggagggctacatggcagggcacagcccggccctgaagcgcctggaaaagggcgaggtaaagatccgggaggcagaggggaaagagccccgcatcgtgcagatcccggggggccatatccacgtgggaaagaccatggcagtctataccagatatgccggctggaaggcgggggaataaaagcagagttcatgcctgtgaaataaaaaagaggcgcgcagatattatacagtatgtatcctgcgcgccattttagaagcaaaaagcaggggaaccgcaaccatttagacaggtctgcctgaacggctgcggaaaattcgtaggaaaccgatgaggtgatgggatgttcattgttttgtttgtactgtggattatattaaacggcaggattacattggaaattgcaatatttggcgcggtgatctgcggcgccttatatttgttcttatataaatttatggagtactccccgaagcgggagctggtgattgtaaggtgcaccgggaagatcttaaagtatgtggtgttcctggtggtggaagtgatcaaggcggccctggcggtgtcgaagctggtcctggagtttgaccgggagccggagccggtgcttgtccgttttaaaaccgggatccggacccagacggggcagacggtgctggccaattccatcaccctgaccccggggacgatcaccgcagacctggaggaggggaactacatcgtgcacagcctggaccgggaatacgcggtggggatccacgaatcgggctttgtggaaaagcttgtggagctggaggctgcggcagagggaggaggaaaaggtgatgtttcatgacatccccgtattgggggcattgagtgagaagtttttaatcgtggtgctggcagtgctctgcgtgatgttcctcctgtgcctgctgcgcctggtgctggggccgtcggtggcagaccgcctgctggcggtgaacatgctgggcgggatcgtgactgcggccatcgcgctgctgggcctgctgctggaggaatcctacctgctggacatcagcctgatttacggcctgatcagtttcctgggggtggtgatcctgtcgcagatctatatcggggcctgccgtgcacgcaatgagaaacgaaaaaagagggaggagggagcgctggatgatggttcttgaatggatccgctttctggcaggcgccgtatgcatggcagcggggcttgtcttttatatcatacagtttatcggtgttttccggttcaaatatgtgctgaaccggatgcacgcagcggccatcggggataccctgggctgcgggctgatgctgctgggtgcggtggttttcaatgggttcaccttcccgagtgttaagatcctgtttctgatcgtattcctctggatgacctccccggttgcggcccatatggtggtgaagctggaagtgctgtcccgggaaaagatggaggactgctgtccggttgaggcagcggaagaggtgaaggcgtgctgcccgtcagaacaggcagaagagataaaggagggggaagcatgacagtcattacctggatcttattggtgtttctggtgctgtgcgcagcagcggtcagcttccataagaacctgttgaattccatcctgatttttatggcctacagcctgatcatgtcgatcctgtggatgatcatggagtcgccggacctggcgattacagaggcggcggtaggcgcgggagtgacgtcccttttattttttgtaactttgaagaagatcaaagggatctcagctgagaaggatgacgaaaaggagaaggaagaatgagcagaaaacgtccgcaggaggagtacaatgaaagcctgtccggccggttcaagcggtggctggacggggaaaaggacccctttgtggggaccctggagatgaagcccccggccccggtgcaggagccagaggagccgtatggtccctccgactatgaagcgatcagaaaaaagagccgggactatccccggaataaaaggctgaaagggtatgggcatgtgtaccgcacggtgagcgtggcagtgtgcctgctgctgattgggatcctggtgtatgcggtgtccttcctcccctccgtgggggcagagtccaacccagccaataatgaagtgcctgcgcgttatattacccaggggctggaggagacgggttccgtgaacctggtgacggggatgatcctgacgtaccgtgcctttgatacctttggggagaccacggtgctgtttatcgcgacctgctgcgtcatgatccttttgatggtggagaatgaggagaagcgcaggaaactgaagctggatgactacggcctggagcctctggaggacacggtgctgaagaaggtggcgaaggtggtatgcccggtgatttttttatttgggatctatatcatcttaaacgggcatctgtcaccggggggcgggttctcggggggcgcggtgatcggcgcggggatgatcctttacgcggcgtctttcgggtttcccaggacccagcggttcttcaatgaaaagatctatgtgatcgtgaaggtgacagccctgctgctctacggcctgatcgccctgcactttttctacacgggggccaacgggctggaacaccttttcccgctgggggagcccggggctattttaagcggggggatcatcctgcccatcaatatctgcgtggggacagaggtggcatgtacaatctatgcattttatgcattgttccggagaggggggctgtaagatgggaagccatttaacggcaaatttcatagaggtggtggcggtcattttgtttgggatcgggtttacggacctgttcctgcataagaacctgatcaaaaagatcatcggcctgaatatcatggatacggcggtgtaccttttccttgcggtaaaggggtacatcaaggggctcaaagcgcccatcatcgtggacggggtgcaaagcgtggaggcctacatcaacccggtgcccagcgggcttgtgctgacggggatcgtggtgtcggtgtcggtgacggcgctgatgctggcgctgactatctgcctgtatcagagataccacacgctggacctggataagatatcgctcaagataagggagaaggaagaatgagttttgtacagaatgtgccctgtttttcgattttagccgccatgtttgcggcgatcatcacgtccgcgctgaaagggaaagcggcccggcggctcagcctgtgcatgacgggggcggtgggggtgatgtccgccttcctgctggcgtttttgatggggacgggggagagctatgtgtatgtgatgggccacttcccggcgccctggggaaacgaactgcgtgcgggcatgctggaggcggccatggcgcttttattctgcgtgatcatgctgctggctttgtggggcggcatggaagaggcgcgcagggacctggaagcggataaggcgaatttttactatatcatggcggacctgatgctggcgtccaacctggcgctggtatacaccaatgacctttttaccgcctatgtgtttgtggagatcaataccattgcagcctgcgggctgatcctggggaaattcaatgacctgaccattgcggcgggggtgcgctacatgatcatgagcctgatgggctcggggcttttgctgcttggcatcagttttttctacgatatgaccgggcacctgctcctgagcaacatcaaggagagcatcctgctgctgtggcagaccggggagtaccgggtgccgctgatcgtgaccatcgggctggtgagcgtggggcttgccattaagagcgccctgtggcccttccatgcgtggctgcccaatgcctatgggaatgccacggcgtcctcatcggccatgctttccagtatcgtatccaaaggctatatcttcctgctggtgaagatcatctaccgggtgacgggggcggaagtgtttgcgggaagcgggatcatcaatgtgctgtttgtattcgggatcatcggcatggtgctggggtccctggatgcggtgcggcagaagaacctgcggaggatggttgcctattcctccgtggcacagatcggttatattttcatgggcatcggcctgggctcagcggcgggggccggggcggggctctaccatatcttcgcccatgcagcggcaaaatccctggtgtttgtggcggccttcggcctgatcaaggtgtctgcggggaacgcggatatccaggggcttcgtggagccgggttccgcaataaagcagcgggtgtgggcttcgtggccggttcgctgtccatggtgggcatcccggggttcggcgggtttgtcagcaagctgatgtttgcggaggcatccctggaacggccggcctatgcggtggtggtgctggcggcgctggcggtgagcacggtgctcaatgcgatttattttatgagagtggtcctgatcctgtatactccgctgactgcggaggaaaaagcggcggggatgaaagagcagacagcgtgcaatccctggcagttcaaggctgccattgggggcggcgtggccctgacgctgtttttgggcattggtgcggcgcccgtgatgcaggtggtcagacaggggctggagatctttggataagggagcactctaaggcagattaggaggaaatatgtacacacaggcgtggattctatgttcaatctttataccggcagcggcagggcttctttttctggtgcttcctgccaaaaaaatggaggagaaaaagatgtcctgggcggcggtggcagccctggcccttactgcagtgtctgtggccctgctgctggtttcctacggccgggggagcggggcagagcttacgctgctgaccctgacagagggcctggacatcaccttccggctggatcacctgggggcttttttcctggggttcattgccttggtctggctgctggggggcatcttttcggtagaatacctgcaccatgaacaccataggcggcggttctggggcttttacctgctgacattgtgtgcgctgcagggcctaagccttgcggggaacctggtgaccatctatctgttttttgaaatgatgaccctggtgtccatgcccctggttttgcatgcccagagccacgaggcggtcatggcggggctgaagtatctcttttactccatgtgcggggcttacatggcgctgttcggggtctttgtgttttaccactttgggagcagcatggatttcctgcccgggggcgtgatggacccggcggtgctggcccagaacgggaccatcctgcacctggggctgttcttcatgatcctgggattcggcgtgaaggccggtatgttccccatgcaggcgtggctgcccacggcccatccggtggcgccggccccggcttcggccgtgctctcggcgatcattgtaaagggcgggatcctggcagtgctgcgctcggtgtattacattgcgggggcggagtttctgcgggggagctgggtgcagtatgcctggctggtgctggcgctcattaccatcttcctgggctccatgctggcctttaaagagccggtgtttaagaagcggctggcctactcgtctgtgagccaggcttcttatattatgctgggcatggccatcttaaatcccgtggccctgaccgggtccctgctgcatgtgttattccatgcattgattaagacggctcttttcttaagcgcaggggcggtcatttaccagaccggatataccagggtggaccagctccgggggatcgggaaagagatgccggtgacgctgtggtgctatacctttgtgtccctggccttaatcgggatccctccggccagcggattcatcagcaaatggtatctggcggaagggcttttggagagcggggtcaggaccttctcctggctggggccggtggtgctgcttgtgagcgcgctgctcacggcggggtacctgcttccggttaccatcgacgggtttttgcccggcaaagattataactgccaggcagggaagaaacgggagccttcgcttaagatggtgctgccccttttcatcctggccgcaggggcgctgctcatgggcgtgttcccgggcagcctgattacatttcttggaaacatagcggcagcggtcgtataaggaggtggggacatgaacgaaacgtttttaatcatagccgtggtttttccgatcgtgacagcggtctttattccgctcattccgtttcggaaacgcgcgcacatggaagtctatatcgaagccgtggtcctgctgacttcggcccttgtcctcctgcttttgtttaaccggccgggggaactggtgctgctgcagttttcagagaaggtgtcctttgctttgaaaatcgacgggatgagcatggtgtttgcggggctggtctcggtcctgtggcccattgccaccttgtattcctttgagtatatgtctacggaagagcgggagcagccgttcttcatgttttataccatgacctatggggtgaccctgggcattgctttttcagccaacatcgtgagcatgtatttcttctacgagatgctgaccctggtgaccatcccgctggtgctccatacctttacccgggaagcggtccttgcgaccaggaaatatatttatttctccatcggcggggcggccctgggcttcatggggctggtctttttggtccgctgcgggggccccggcgggttcaccctgggggggatcctccaggggcatacggcaggccttgggatggacctggtgctgctgctctatgtggtggcgtttttaggcttcagcatcaaggcggccatgttccctttttattcctggcttccggatgcgggcgtggcgcctacgccggtgaccgcgctgctgcatgcggtggcggtggtaaaggcgggggcatttgccgtgatccggctgacctattactgttttggcacggagcttctgcgggggacctgggcacagaacgtggtaatggccctggccatgttcacggtggtgttcggctgcagcatgggcgtgaaggagacgcacatgaagcggcggctggccttctctacggtgagcaacctgtcctacatcatctttggggccacgatcatgacgccggcgggccttttaggcgcgctgtgccatatggtgttccatgcggtcatgaagatcagcgcttttttctgcgccggatccatcatgcaccagacccacaagcactatatctatgagatggacggttttgggcggaaaatgccctgggtgtacggggcctttacggtgtcggccatcgggatgatgggggtgcccggggggtgcgggttcatcagtaaatggtacctggcaaagggggccttagaaagcgggaaccacctggcctggatcggggtggggtgcctgctggtgtcggcgcttttgacggccatctatatgatgaccatcgtggtaaggggcttcttcccggagaaagggtttgatgagaaggccctggcgggggtgaaggaccccagctggcagatggtcctgcccctgctgctgttttccctggcgatcatcgggttcgggctgtacagcacgccgcttacggatttcctggcgaaggttgtgacgggcgtgtattagagtggataaccggaaggcttttgtgaaaaggccggtgtgtttttgaagacggtaaccggtgaatttgaggaagcagtaaccggtggattacaggaggttgagaatgaggtattttaggaggtggcacgcatgaatggaatccaactggcagtcccggtgttttatcccatggccggggcgctgctgacctatctgatcgggaggaaatccaaggagggacggaattactttgcggatttcatcgtcattacggaattcctgctgctgctctatggggcattgcgcctgcaggggagcgagggcatcctggaggggatctgcgggatgggcctgcatttcagtatggacggcttccgggggatctacgcggtggtggccgggttcatgtggatgatgaccattgtattttcgcgggagtatttcaggcattaccggaaccggaaccggtattacttgttccagctggtgaccctgggggctaccgtgggagttttcctgtccgcggatttatataccacgtttctgttttttgagatcatgtcctttacgtcctacgtgtgggttgcacaggatgagaggaaggaatccttaagggccgcccagacttacctggcagtggcggtgatcgggggcatggtgctgctgatggggctgtttctgctctacacgtccgtgggcacgctggagatcggggcgctctatgaggcctgccaaagttatccggataaaaggctgctttatatagccgggggctgcctgctgttcgggttcggggcgaaggcgggcgccttcccgctccatatctggctgcccaaggcccatccggtagcgccggcgccggcttccgccctgctgtccggtatcctgactaaggcgggggtatacgggatcctggtggtcagctgctacatgttctacggggacgaaaagtggggcagcctgatcctggccctgggcgtggtgaccatgtttgggggcgcggtgctggcagtcttttccgtggatttaaagcgcaccctggcgtgctcgtccatgtcccagatcgggtttatcctggtggggacggggatgcagtgcctgctgggggaggaaaacgggctggcagtgcacgggaccttcctgcacatgatgaaccactccctgatcaagctggtgttattcatggcggcgggcgtagtgtttatgaacacgcaccagctgaacctgaatgagatccgtgggtttgggcgaaagaaaccgttcttaaacctggcctttctgatgggggccttagggatcgggggcatcccgttctggaacgggtatatcagcaagaccctgctccatgagagtatcatcgagtattccaaggccccggtgtttgtgtttgtggaatggatgttcctgatcagcggggggctgacggtggcgtatatgctgaagctgtatgtgtcggtgttctgggagaagaatgcggatccggcaaggcaggcggaatttgacggcatgggaaagcactacatcaataagcagagcatggcggcgattggcgtgagcgcggcagtcctgccggtgctggggatgacgccggtgaaaacgatggaagcgctggcaggtgcggcccagggctttatgcggatggaaggggaggcacatatcccccacttcttcagcatggagtgcttaaaaggggggctgatctcaatcgccatcggggccctggtgtatctgctggtgatccggagggtgttcctgcgcaagaaggaagggggcgccagcacctatgtggatgcgtggccgaaatggctggacctggagaacctggtgtaccgtccgctgatccagggggtgctgccgtttatcgggatctttgtgtgccggatcggggattcgctggtagacggcctggtggtggcgcttaggaagacgctgtatagggaccggaagattccttaccgtacggggtcgctgccgaaagtggacacggccatcgggaagctgctggatcaaggcgcggcgtacttaaagaagcaggaggagaatgtgtcataccgtaggaagctggggatccgtgcgctggagaggaaggaaagccgggatatgatccgttacagcctttcatatgggctgcagctggcggggattgggatgatcctgatcctggtgtatctgctgctgtagggcaggaaagctgaggaggaaaataaatggggaacgaccatttataataaaagaggaatagaagagaaaggattggtgtcagaatatggaagaagtgagagatataatcaaaaaattttctcccgaacaaatcaagcaatatctggatcgtataggaatgcctccggtgaagggacctaccagagaagtattagacgagctgatctatcgccatcagtgcacgattgcatttgaaaacttagacagctacgacttccataaggaagtatgcctggatggagattatttgttccagaaaattattcagggtacaagaggcggctactgtctggaattaaacggcttattttaccgtctggtcgtcagccttggatatgatgcaagaccatgttttacaagagttttattgggaaaaaatgacctgagatggccaattgaccacaggggaactctggtaaagctagacggtgcagaatacttttgcgacgtcggccttggcgggccaatgccgtcaggcgcactaaacatcgaaaccgaagaatggcagacctttggagatgagtcattccgtgtcgttccctgcatgagaggctggttagcaatccatcgcaaaacccgtatcaaacaagaagtcgaaccgggaaaagcacctcagaccgaaagaatagaagtggttatttccgacatcgcatgctttgacacagacttcaacttcttaaactactataaatcgactaaaaaagagtctttattctgtgcccacagagtctttaaccttagaatcgacggagggtatcggtcgataagagacgatatatataaagaggtaacaacaaaaggccttgttacagaaaaaatcagtgagcaattagaagaaatcgaaccattgataaaggaaaagtttaatatagaaatataactgataaagaagccagctccaaaaggcgcaccgctgtaaccgttctggcttatctgaactgttgcgtaccgctttctgccccatctattttccaaaagtacggactactagttttgggcaaaagatgatacaatgaaaagaaaagggttggtgaagcttatgaaactgacatttattggagcagcccatgaagtgacgggaagttgtcatctgctgcaggcggcaggtaaaaacattctggttgactgcggcatggaacagggcccggatctgtatgagaatccggggcttccgattccggagacagatatcgactatgtgtttttaacccatgcgcatattgaccattcgggcatgctgcctttacttacgaaaaatgggtttaaaggccagattatcacaacttatgcaacggcggatctgtgtaacattatgcttcgtgacagtgcgcatattcaggaatttgaggcggaatggcgcaacagaaagggcaggcgtgcagggcagccggtgtatgaacccatctatatacttcaagatgcgctggatgcgatagagctgattgtaccctgtcaatatcaggaacgtatccggatctgtgatggcattgaagtacgttttacagacgtggggcatctgctgggatctgcgagcatcgaggtatggattgcggagggagatactacaaagaagattgtattttccggagatgtaggcaatacaaatcagcctatcatcaaagatccaagttataccgaatcggcggactatgtagtgattgaatccacctacgggaaccgtgtccattctacagagaagatcgattacctgaaggatttcacaatggttctgcgggaaacatttgagcggggcggcaacgtggttattccatcctttgcagtcggcagaacgcaggagatgctgtattttatccgagagatcaaagagcggaagctgctgaaggaatatcccgattttgaggtttatctggacagtccgcttgccattgaggctacaaaagtctttaccaaaaacatgcgggaatgctttgatgaggaagcaattaagctggtaaatgaaggaatcaaccccctggtttttccaggattaaaaacctcgacaaccagtgatgattccagaatgattaattttattgaaaagccaaaagtaatcatatcggcctctggtatgtgtgatgccggccgcatcaggcatcatctcaaacacaacttgtggaggccggagtgtaccattttatttgtaggatatcaggcaaacggtactttgggaagaaggctgctggatggagacaagaatgtcaagatatttggtgagccaatcgaagtgcgtgcccggatagagagtcttcacggggtcagcggccatgctgatatgaacggccttctggactggctgggaggattcaaaacacctctggagagagtttttgttgtacatggatcagacaaagtaacagaagaatttgcagaaacgatacaggagaagctggggcacccaacctgggcgccattcccaagctgtgaagtcgacctgttaaccaacgaaatcctcgacgagggcgtcaaaatcccagtaaaggcgaagaaaccaacccagaagaaagcagacgcagcattcgaaagactgcttgcggcaggcaaaagacttctggatgttatatacagaaatcaaggcattgccaacaaagataaggctaaattcgaaaaccaaatcaacaacctcgcagacaagtgggatagctgggagtaggaggggaaaactaaactgttgcgccgccacatctgaaacaagataaaaaagaaagatagggcttgcctttacgtagcagcccttatctttctatgtgataaatagcagtatgagatatttacagggcatttttcattagtgatatttcatattgcaattgtttgggggatatatgtatagcggctggctgtgaatagattttgtacataaatccacctttttttgaacagagcgcttgtatcatcttagcagtatattctttcatctgttcaggggtcatggcaggactggattgaatatctattggacaccagaaacagattttatctttccactggctaaggatatcaagccccatattcatttgctgatccaattgaataacatcaattcccatttcgataaatgtatctagaagataaataatatgcccgcaagaatgtaatatgtatttcatgtttttaccgtgtacatagtttacaaaatctttcatacgctcataataaaaatccttccacaaatcgtacgatatcatagggccattttgaagtccccaatcttcccatgcgatcaccgcatcaagtccggcattggcatatccgtcaaccatttttttgcctgcatcatagatacagtcaattaattggttcaaattggcttcctcatcataataatccatcatacaattcgcatatccgcgcagattgatgatctccatcatcatcatacttaaaccgccaatcaaaaatttatccgggtatttttttctcattatatgagattcacgatatcggctatttgatgtgaaatctggtaaatttgctttccaatgttcaaaattatcccaacgcccaagtgggggattgcgaacttctcccattgtttctccgaatgattctaatttatatccccattgggaatacccatgctttagcggtttgaaatcaggatcatccccataaatagaaatgatatcaccttcttcttctggcggaagttcctgtgctattttttggttatagggggctaggagtaatggctgtatatgtagataaagcgtatttttatgatattttggatgattttgaaatgcaaggtgttggaatgtgctatttattgaatgaggatggaaatgaaataaacggcatacaaattccgaaagagaatagtaaaagatatagttacccattaacgagcaatgattggtcacttttatgtatacaaaatatagataaaattaatttagatcttgttttgattcggtggcttgcaataggcctattcctagtattggttgttttaatggtgcttataagcattgccatgtcccgtactatatcaaaacctattattgatttggaatattcaatgaaagaattttccagggggaattttgatatgaccatctctgctaaatataatgatgagattggtaatttacgcagatgctataatcagatgattttagatatgggccgattagtagaaagaaacttacaggaagaaaaattaaagcaggaggctcaaataaaaatgctgcaaatgcagattaaccctcattttttttataatacattagataccatccactggttagcacagatacatggagagaatgaaattgttgaggtttcacaggcatttggaaaattgatgaggttttctttggaaaaaaatgaaataataccgttcgaaaaggaactagatgctatcgataactatatgaagatacagttttatagatttggaaatcagttatctttagacgagaagattgaagaagatttgtattatgagtacataccaaaacatattatacttccaatagtagaaaatgctatagaacacggtttctctggaatggaagatgaaaaaaaacttataatcagaggcaaaattaatgatgaccagattatagtagatgtatttgataacggatgtgggattaataaggaacaaatagaagatatattgtaccgtaagaacatatcgaaagaaaaacatatgtcaatcggccttgcaaatgtgcagcaaagattagcgttattatatggagaaaaggcgggtattaaaataaatagtaaaaaagatatgggtactgttgtgtctgtatttttaccgatgaatagaagaggtgagtagctatatgaaaggaaaagactttttaaaagacatttggaatatggtggaggtaaatagaccgggatttgttttggaagagccggcatttcgttatcagagcctgagcgtgaataaaagtattgagcaaatatatcaaaaccgttatcagaaatacgaagctttaaatgcaggaagaacagataatgtgggagtaatggactgcatgtttggtacacatatattgccgtgtctttttggcggagaagaacgggtttttgctgatggacatacttatttggaaggcccgattattttttcgccggaggatgtgtacaaattaaaggtgaatgatattaagacgggggtaattggccggcaaattgagatattgaaatatatggcagataaaacccagggagagattccaattcgggtgggtgatattcagaatccattgggtattttggatatgatgtgggagactgcagatttttattgttcgttgctggaagaatcggatgctgttcataaagcattggaaattataaccgaagtagaaattgagtatatccatgaaatgtataagattagtgaaaacattgtgccgctttcctggccgtttatttgggcaccgaaagaaaagggcgtatatcttgctgatgatacaatgggtatgatttctccggatatgtatgaggaattcggtgttacttataataataaaatatcagaagaatttggtggtattatgttgcatagctgtactacaaaagaagaatattttgataaaattatgaaaaataaaaatattcgctctataaatttcgcctcacaatattcatcggatatgaataaaatctatgaattttttggagggaaggttgtaataattcctcattattgccatactgacaatcctcaaattggtacagtgacagaatttttagaaaaagttatttcttgttggaagcccgagtatccgtcaataatttacattatggagaatccggaacaactgatacaacaggatgtatatgaagttttttgtaagtatttcaatttaggagattagtatgaatgatagagaacgagcggaactattggtatccaaaatgacatttgctgagaaaatggcgcagatgcggtacgatgcactgcctatcgaacgacttggaattcccgcatataactggtggaatgagtgcttgcatggtgtggcaagatcaggaagagcaaccgtgtttccgcaggcaattggcatggcatccagctttaatacggagttaatgtatgcggtggcagatgctatatcagatgaagccagggcaaaatataatgaatataagaagtttggagaaacagaaatttatcagggcctgacgatgtggtcgccgaatataaatattttcagggatccgcgctggggcagggggcaggaaacatatggcgaagatccatatttgacagggagaatggcagttgcatttattcagggattgcagggaaatggcagatatcgaaaagtagatgctacgattaagcattatgcagttcacagcggtccggaagaccaaagacatggttttaatgcggaagtaacgcagaaggatttgtatgaaacttatttgtgggctttcaaatattgcatagataatgcagacccttctgcggtgatgggagcctataatagtgtaaatggtgatctttgcagtgccggtaagaaaatgctccgggaaattctccgccaggaattgcatttcgatggttatgttgtatcagattgcggtgcaatctgtgacattaacaaatatcataaggcaactaaaaatgaagcagagagtgctgcgatggcggttaataatggctgtgacctaaattgcggaaacgcttataaatggttgaagacagcggcaacaatgggattggtatcagaagaaactatcacagattctgtggttcgtctttttacagccagatatcgactgggaatgtttgatacagattgtgagtatgataagataccttatgaagttgtggaatgtgaaaaacatagagagttaaatcggaaaatggctcaggaaagcatcgtgttattaaaaaacgatggcatactgccgctgaaagaggatgtaagaattgcagtgattggtccgaatgcagatgatgtatccgttttattggggaattataatggaacaccttcatattatacgacaattttgagagggatacaggagaatgcgaaaggacaggtgctgtatgccagaggctgtgagttatatgatgatgctgttcgtgagtgggcagagaaaccaatgagagaagcgataatagctgcacagaaatcagatgtggtggttttggttatgggcctgaatccttatatggaaggagaagaaggcgatgaatataatggctttttatctggagacaaaaaagacctggaatttccggcgccccaaaaaaaattatatgaggcaattgtaaagaccgggaaaaaaatagtgtttgttaatgtatcaggaagttgtttgaatttatacaatcaggacagggaatgctcagcagtgctgcagtgtttctatccgggagcggaaggcggaagagcatttgcagacattttatatggacatgtcagtcccagtggaagactgccggtcacgttttatcggtctgtagaagacctgcctttatttaaagactattcaatggataatagaacttacaaattttataaagggaaaccagtttatgaatttggttatggcctcaccttttctgaaatccaggaaaaatgggtggatgagaaccatgttgaagtccacaatgtgggggaatatgatactgcatatacagtattaaaatatgaatggataccgcacaaaagtttgtgtggatttcaaaagatttttttacggaaaggcgaaacaatagaggttcgtttttagtgtggataaaagatttataatagggctgactaactggaaaacatctgtagatagtcaggaaggaggacacaaaagatggtattcaaggagtttacggcagaacaattaaaacatatcatagaaggcaaaaatgcctatgaaaggattccgatgatttatgatttctggaccccagcagaaagattgggaaaagatgaggcaagggcggtagaattgatggaagtgtatccttgtgatgcgcagttcatacaaatatgtatgccggacgtatcagatgcacctgcagatgatccggagtacaaatggctttacagagaacaaaagaaacaggaatcagcgagctatgacgcgcagatattaatcgaagactgggaagagctggatgagattattgctcattttccagaccccaaatatccggggatatttaaggagaaaggaaaggaagactccagatataaagtcgcctgctggtggtactgtttttttgaacggctatggtcattgcggggaatggaaaatgcgctgacggatttctatttttatccggatgaagtacacagattatttcagaagctgacaaatttttatatgcaggttatggagcgggctaaaaatgaacttaatgcagatgctatattcacgtcggatgatataggtacacagacagggccttttttttccgagaaaatttttgttgaattttttaaaccctattataaacagctgtttgataaggcccattctctggacatgcatttctggttacattcatgtggaaatattgaattatttttaccgcacttcattgaaattggtttggatgtgattcatccaattcagaaatatacgatggaagaagcaagaattgcaaagttatatggtgataagatctgtatctgggccggatttgatgtacagaagaccattccatttggaacgggtgatgaagttcgagaagaagtaagatttatgatagacacatatgcccgtaaaaacggcagatttatgctggcctgtggaaatcgcatcacatctgactgctcaatagactcctttgaggcgttgctgggagaatcttatgattacggaaacgaaaaaatgaaaaatttggttcatgcggaagaggtttaaggcagtgcctgaagcggaacgccggagtttcggatcaagttagctcaagggaacagttcaggcttgcctgaactgttacggcttgaggatggttcacaaactcattcgccaaaaactattgacttttaggtgtgatatgctaaaattatcgtgacatgcatagatacaatcgttctatcatgcaaatataggcctgacagttttttctgtgaaaagctcatcggacagggctggccgctgccgcgggtggcgatagcgccacatttattgatcgagttaaaagctcagttttataagttggttactttataacctgcaaatgcataccacttgtgaaatgttcaatagaggagtagtaaaagtatatttgctgtatagactctgataagaggacaaattgattgtatacgctgtgcggatattctatctttccagaggaaaggcggactttgtaacccataatgtatatgacaggtagtgttgcttttgcacactgccttttttgatataggaaattattctgaaatttcctattgcgaatgttttctgttttgtgttttatatctgcaaaacttaacgaaatcacagatacacaggagaaagaagaatggataaaaagcgacaattacaggcaccgatttacagcgctctggagcgcttccgcaagcagcgggtcgtaccttttgacgtgccgggccataaaagaggcagagggaatccggagctggtggaactgctgggggaaaaatgcgtcggaatcgatgtgaattccatgaaaccgctggataatctctgccatccggtttctgtaatcaaggaggcggaggaactggcggcggatgcgtttggcgcggcacatgcctttctgatggtgggcggaacgacctcctctgtgcagagcatggttctctccgcgtgcaaagcgggggataagattatactgcccagaaatgtacataaaagcgtgatcaatgcgctggtgctttgcggagccgttccggtatatattgacccgaaagtagaccagctgctggggattccgctggggatggagctggaggacgtacgcagtgcgattgaagagcatccagatgcctccgcggtctttgttaataatccgacttattatggaatctgttctgatatcaggagcattgtggagctggcgcacagcaagggaatgctggtgctggcagacgaggctcacgggacgcatctttatttcggccagggtctgccctgttctggtatggaggcgggggcagatatggccgcagtcagtatgcataaatccggagggagcctgacgcagagttccctgcttcttctgggaccgggcatgaacgagcgctatgtctcccagatcgtgaaccttacccagacgaccagtgcttcctatctgttaatggcaagcctggacatctcgaggaggaacctggcgttaagaggcgaggagactttccagaaggtagcgcagatggcggaatacgccagagaggagatcaatgggatcggggggtattatgcctatggttccgaactaaagaacggcggcagtatctttgatttcgatgtgaccaagctggctgtctatacgcgggacatcgggctggccgggattgaggtttatgacctgctgcgtgatgagtatgacatacagattgaattcggggatatcagtaatatattggcctatatatctatcggggaccggctgcaggacatagagcggcttgtgggggctctggcggatatcaagcggctgtaccgggagccaaagaagaatgtttttctggcggaatatatcgccccggttgtggtaacaacgccgcagcaggcattttatgcggagaaggagagcctgccgattgaggagaccgcgggaagggtctgcggggaatttgttatgtgttatcctccgggaatcccaattctggctccgggcgagcagattacggaaaaactgatccactatatccggtttgcacaggataagggatgttctatgcaggggccggagagcctggatctttcaaggctgaatgtgctaaaggaggatggttgatggatttttgggtaagtgagatgcataccaataatgtaaagatctcgattcgtgcagagaggcagctgtttagcgcgcagagcgaatttcagcggctggatattttcgagacgcctgaattcggaaaagtactgacctcgaacggaaatgtgatatttacggagaaagatgaatttatttacgatgaaatgattgtccatgtgcctatggcggtgcatcctcatgtcaaaaatgtactggtgctgggcggcggggacggcggagtggcgagagagctgtcgtattatgaggagatagagcatattgatgtagtcgaggcggaccagctgtttgtctatgcgtgccgggaacattttccggaggatgcaaacgggctggatgacgacagggtgtctatgtattatgaggacggactgaagttcctgcgctccagacaggatgcctatgacctgatcattaatgactgtacggatcccctggggcatgcagcggggctgttcaccaaggaattttacggaagctgtttccaggcgctgcatgaggacgggatcatggtgtatcagcatggaagtcctttctatgctgaggacgaggaaagctgccggatcatgcacagaaaagcataccgcagttttcccgtaaacagggtctatcaggcccatatccccacctgccctgcaggctactggctgttcggctttgcatcgaaaaagtaccatccactcagaaacctggacgctaagagatggagagaacgggaaatacagacgagatattacacgacaaacttgcatacaggggcatttatgctccccagatatgtggaggatttattagaagaggaggaagtttgatatgagcagaatattagtgatcggttgtggaggcgttgcttcggttgccatcagaaaatgctgtcagaatgagaaggtatttacggaactttgtattgcaagcaggacaaaagcgaagtgcgatgcacttagggaaaagctggaagggaaaacatccgtaaaaattacaaccgcacaggtggacgcagaccatgtatcggaggctgcggcattgatccgcagttatcagccggatgcggttttgaatctggcgctgccatatcaggatctctctatcatggaagcctgtctggagtgcggcgtccattacatcgattccgcgaactacgagccggaggatacggatgatcacgcgtggcgtgcagtctatgaaaaacgctgcagggagaaaggatttaccgcgtattttgattacagctggcagtgggagtacaatgaaaaatttcgggaaaagaatctcaccgcgctgcttggatccggatttgaccccggggtgacaagtgtatttaccgcctatgcaatgaaacattattttgacgagatccatacgattgatatactggattgcaacggcggggaccacggctatccgtttgcaaccaattttaacccggagatcaatctgagagaggtgtctgcaaacgggagctactgggaggacggccactgggtagagactgaaccgatggaaataaagcgcacctatgattttccacaggtggggccaaaagagatgtatcttctgcaccatgaggagatcgaatctctggccgtgcatgttccgggagtgaagcgtatccgtttcttcatgacctttggagagagctatctcacccatatgaaatgcctggaaaatgtagggatgctctccaccagcccgattgtttttgagggaaaggaaattgtccccatccagtttctgaaagcgctgcttccggatcctgccacactcggaccgcgcacaaagggaaagacgaatattggatgtatttatacaggcgtgaaggatggacaggagaaaaccatctatatctataacgtgtgcgatcacgaggaatgctaccgggaggtggaaagccaggctatcagttataccacaggggtaccggcgatgatcgggactgcattggttgcttcgggtatttggaataaaaggggtgctgtgaacctggaagaactggatccggatccgtttatggatatgctgaaccagtacggccttccctgggtggtggatgaaaatcctgaaaccgtggagtaggggaacccacatccggcaggaggtacggcagggtaacagttcagacaggtctgaactgttacgcatccagcccattgaaattcgcctgcggcgaagggctgaatgccggcaaccactatgctttcttacggtctgcgcagtaaatgcgcagacctgtctgaacttttactcggcaggccgcataatcatgaaaacacgaggaaagagtagtgaaagaaaacttattaagaacagaagaccttaggacaccggtttatcttgtggatgaagcaaaactggagcataatctggagatacttgaaagcgtgcaggaggagacaggatgcagaatacttctggctcagaaagcattttccatgtatcgggtgtatccgatggtccggcattatcttgcgggcgctaccgcaagcggactgtatgaggcgaggctagctgcggaggagatgggcggagagaatcacgtattttctcctgcgtataccgcagaagagatggagaagctctgcaggatttgcagccatatcagcttcaattcgattgcacagcttgagcgccaccggcccttgtgggaaacgaaggggatcagtgcagggcttcggattaacccggagtactctactcaggaggggcctgccatttatgatccctgtgcgccgggatcgaggcttggaatccggcgggatcagtttccggagcggcttccggcaggggtggaaggcctgcatgtccatacactctgtgagcaggatgcggccccgcttgtggagacgttcgaggcggtggaggagaagttcggggaataccttcaccagattcgatggcttaatctcggaggcggacaccacatcacaaggccgggatatgatattgctgtattgaaggacctgctctgccggatacgggatacctaccatgtacaggtttatctggagccaggggaagcggttgcactgagtgcaggatatctgatcacggaagtgatggatattgtggagaatgtacctccggttttgatactcgatgcatccgcagcctgccatatgccggatgtgctggagatgccttaccgcccgcctctgagggatagcggtaaaccgggggaaaaggcggttacatgcactcttggctgcagaacctgtctggcaggggatgtaattggagattacagctttgacgagatgcccagaatcggggaacgcctggtgtttgaagatatggcaatctacacgatggtgaaaaataatacttttaacggtatgccgctgccggacattgcgcttctcagaaaagacgggatgtgcgaggttgtaaaacggtttggctatcaagattttaaggagcgtttatcctgatgaataagttgacaacgccgcgggaagacggctattttatgcctgcagaatttgcgcctcacgaggctgttattttaatctggccggtgcggccgggaagctggggaaagaatcctgagagggcaaggaaggcatttttagagattatacgagaggcatcccggagtgaaaaagtatatttactggcagaccgggaacataaggaagaggcggtacgcgcggcaggcaggtttgcggaagttctggcagtggggagcgatgatgcctgggccagggacgtggcccccactttcgtaaccaatggaagggatgtcaggggcatcagctggcgttttaatgcctggggcggcagcatagacggcttgtatgcctcctgggataaagacgatgcggttgcaggtgtgcttctggacaaactgggttatttctgctatgatgccggagattttgtgctggagggcggttctatccattctgatggggagggaaccatattgacaacaaggagctgcctgctcagccccggcaggaatccgcggctgtcaaagctgcagattgaggataaattaaagcaatatctgggagccgaaaagatattgtggctgcccaggggaatctatatggatgagacgaatgaacatgtggataacgtctgtgcgtttactgcgccaggagaggttgtgcttgcctggacagatgaccgtgaggatccccagtatgaactttccagggcctgcctggattatctggaaaaacagacggatgcaaaaggccgccggctgaccgtgcacaggctgcctatacctgatgtacccgtgagggtcacacgagaagaagtggagcagtttgtgtttgaagccggagaagatatgcgggaagccggggaacggctggccgccagttatgtgaatttttattttaccaacgatgccgtgctggtgcctcagttcggtggtgacaatgaagaaagtgacaggcgtgcgctggaaatactgcggcccctgtgtccgggacgcagggtgacagggatagacagcagggcgattttgcttggaggcggcaatatccactgtattacccagcagattccagaaggaggaggaaatgagtgaggttacggttgctgtgattcagatgcagtgtactgcagatgtacagcagaatatgaaaacagcagaacggctggtcaggcaggcggcagagcagggcggtcaggtgattctgcttccggaactgttcgagcggcagtatttctgccaggaacggcgatatgaatactatagctatgcgcttccgacagaggacaatcctgcggtgcgtgcaatgcagaacctggcaggtgagctggggcttgtgattgtggtcagcttttatgagcgggcgcagaacacactgtataactctgctgctgtggtggatgcagacggcagcctgctgggagtgtaccggaagacacatattccggatgatcatttttatcaggaaaaattttattttacaccgggagacaccggatttaccgtgtgggatacaagatatggccggattggagtcgggatctgctgggatcagtggtttccggagacggctagaagcctggcgttgaaaggagcggatgtgatcctgtatccgactgccataggcagtgaaccgattctggactgtgacagctcgggacattggagaagagctatgcagggccacgcggcggtcaatatcgtgccggtggcggctgccaacaggttcgggctggaaaaagtagagccatgtccggaaaatgcgggccagagttccagcctggtgttctatggcagcagttttataaccgatgaaacaggagcagttctgtgccaggcgggcagagatacggaaaacgtgctgtgcgcccggtttgatttcgagaagatcagaagagaaaggctggaatgggggcttttcagggatcggaggccagagtggtattgagttgacgagatttagactcgtcgacggatggggggcgcaccgtaaagggatagccgggaagcgccggaagagtatatgcccggcggaagtgcaacccgtacattaagaaattctaagcagaaaaaggcagaaaattggagcacagctgacacatcgtaagaaatctgatgatttctcacgctgggtcagcagaaaacgcgcttcggaagcacgttttctctccaattttctgcctttttctgctaagaatttctaagatgtactccagcatttccgccgggcatatactcttccggcgcttcccggctatccctttacggtgctgcgtgcatccaatcggcaggcaagaacagttcgtcaggagggctccaaacgggggcagtgtatgaattcgttctttccattgataaatgaatgcagatttttggttccacaagcgaatcaatacgctgccccggttccgagcctcccgagttgacaatcataactaccgattggatgcactcagcgaaatgaagggagagacgcaagcctcccaagtgcacatatgccgtttcgaggtgctaaagcggatcttagaaattcttggaagccggcagccgaaaaagtagggaaattttgtgatcaccgaatcacaaaattaggcggcccagcgcgagaaatcatcggatttctcgtgatgtgccgccggtgccctgctttttttagctgccggcttcctagaatttcttaggtccgcgtccgcatatcgaaacggcatatgtgcacttgggaggcttgcgtctctcccttcatttcgcgccccccttcatcaattccccctttcatttgtcaaggtctaaaactttttttaatttgcgcatcttcgaataacccgccttcagattgagaatgattttactagattcaaattttcatctaggagggtttatattatggcactgaataaagttgaattgtgtggggttaatacggcgaagcttccgctcttaaaggaagaagaaaaagaagctttgtttgtgagaatcaaggcaggagatgaggaggcccgtgaggaatatattaagggcaatctccgcctcgttttgagtgtgatcaagcggttttccaacagcaacgaaaatgcggatgacctgtttcagattggctgcgtggggctgatgaaggcggtggatcattttgacccggacagactggtgaagttctctacttatgcggtgcccatgattatcggagaaatcaggagatatctgcgggataataattccatccgggtcagccgctccctgcgtgatacggcctataaagcaatttacgcaaaggaaggctacatgaagaaacatctgaaagaacctaccgtgcaggagattgccgaggagatcggaatctcaaaagaggatatcgtctttgcactggacgcgattcagatgccgatgagcctgcatgaaccagtatatagcgatggcggcgacacgctttacgtgatggatcaggtcagtgacaaaaaaaataaagaagaaaactgggtggaggagctgtcccttgaggctgctatggaacgcctgaatgaaagggaacgctatatcattaccttaaggtttttcgagggaaaaacgcagatggaagtcgcagaggagattaaaatatcccaggctcaggtgagccggctggagaaaaatgcgctcaaggtcatgaaacagtatctgctgggctaaaataactgctatgcataccagggccctgcactgaaacaaaaatatatagaatccctgtattttatggttgaaatttccatgacttcatactattataaacgtagactaaaggagggtatggagaggaaccatgtataaactatgcatttttgatttagacggaactttaacggatacgttggattctctgactttttctgtgaatgagacattgaaggagatggggctttccccgatcaccagtgaacagtgccgcatgtttgtgggaaatggagcaagggtattgatggagaaggcgttgtgggaaagcgccaaggctggtccggaaaggctggacgaggcaatggagatatacggccgtatatttgacgctaactgcacatatcatgtaataccatatgacggtatcttaaagctcctggagggcatgaaggcgcgcggtatctgtctggcagtgctgtccaacaaacctgacaggcagaccgtgcatgtggtggaagagatattcggtaaggatacgtttcaatggattcagggccagaaagaaggcatacccagaaagccggatccttatgccgccctgcagattgccgggaggtttggggctgagccggaagagtcactgtatgtaggcgattcggaagtggacattgcaaccggcagggcagccgggatgaagaccataggagtgtcctggggctttcggggaagagctgcgcttgcagaggcgggagccgtgcatgttgtagattctccggaggagattctgaatttgattacttaaaagggagggaaaagaatcatgtatgaatatgatgatgagtgtctgcttacatttctaaagaagcagtctcagctatttgatgagccggtggcagagaccatcgaggcagcggaggctttcctggaggactgcatggccgcagtcgtggattcccttgatgaggtgagggaatattttgaggaaagcgggattgacgtggatggaatgtcggacgaagaactggaagaggcgtccgaggtctttgcacttccgaacggacaatatttgattgtggaaggttaatccgaatacttaaagcaatgaaacacaaaagccgcagcatcatttcactgcggctttttctgtggcctcttttatggcatccagaataacctgggatgtatagggggtgtcgtctgacagtgagatatcctccagggactgcttctcatagacctgatctgctatatcttcgattgccggctgaatcagaggaaacatggtggtcattgcctcatccagattggaaaatcggatagaattgatatgggattcatctacggatacttccacttctagatttgtattgtttaacgtcagcgtcgaggtatagactcccggagtatactgctttttcgcatctgcactcttatcttttccgccgggacggaacatgacaatcagcagtatgatcagaagaatgccaagtgccgcgaagactgccgtatagatgatttctttcatatgcagaacaataatttttgttttggaacccattgaagagacctcccgtgttagtcaattttacttccctgtaatgggcaggtaaggaaaactgtccattgcgctttttataagtgtatgacgtgaagggaaaaaatattcgcgtcttttgcgtgacaaatagaatggcatcctgtaaaatggataagaatgaagaggtgaaaaggatgtatatcatagcaggtctgggaaatccggacagacaatatgaaggtacgagacataatgtgggattcgaagtgatagataccattgcttcgaaatataatatagcagtggacacgaaaaaacacagagccttcattggcaagggtgtgataggcgggcagaaggtaattctggcaaaaccgcagacatatatgaacctgagtggagagagcattatcagccttgtggaatattataagattgatgaagaacaggaactgatcgtaatatacgatgatgtcagcctgggggtcgggaagctccgcatccgtgcaaaaggcagtgccggcggccacaatggaatcaaaaatatcatcgctcatcttggaagtgaggtatttcccaggattaaaataggagttggtgagaaaccgcccaaatatgatctggcggactatgtacttggacattttaccaaggcggagcacgagttgatggaggaaggttatgggaatgcggttcatgccatagagatgataatatccggtgagattcaggctgcaatgaatgagtataaccggaaaaagaaggaagagtagagaatatgcaggcttttttagcgccgcttgccgagctggcggagtacaaggagatattcggcagacgaaagaaaaacagcggggttctgcagattacaggctgcgtcaattcccagaaaacacatttaatgtatgcactgagcgatggttgttattataaaatcatcgctttttccagtgatgaaaaggcaaagaaggcttatgaggaataccggttcctggatgataatgtgtatctgtatccggcgaaggaccttctgttttaccatgcggacatcaagggaaagtacctgattaagcagcggatggaggtggtgcgtgccatacttgaggcggaggaaatggagagccgggggaagggcggaatcacggttatcacaacgatggacgcttttttggatggtatgcctcctctgcgggaaattgcaaaacgcaggattcatgtggaagggacggggacactggatttaataaagctgcaggaaaagctttccgcaatcggttacgaacgggaggttgagatcgaaggccccgggcagtatgcggtcaggggaggtatactggatgtgttccctctgacggaggagctaccggtccgcattgaactgtggggggacgaggtggattccatccggacttttgatgtggaaagccagcggtcgatcgagaacctggatgatgtggacatttatccagcagcggaattccttggagagcgcgggaaaagcgtctctttcctggattatttcccaaaggaaaagagtctgttgtttttggatgagcctctgcgtctggcagaacatgcggatgagaccgcagaggagtatctgaacagccggaaaaacagggaagaagccggaatgcaggaggaagaggaaccggaaatcttttctacgaaggtgattgtagaaaagatgaatcagtattacggcatcggcctgacaacgctggaatctaaatgcggcgggtttcatgtgcgggatacctacagcctgcagacgaaaggggtcaatccgtacaacaacagcttcgagatgctaacaagagacctgaagcgcctgaaaaggagcggttaccgggtgatactgctttccggttcccggacccgtgcaagacggctcgccgaggatctgcgggattatgatctgagtagtttttacagcgaggatatgcaccgggaagtgcagccgggggagatcatggctgcctacggacatgttgcggaggggtacgagtacccgatgctgaagtttatggtgatatccgagacggatattttcggaaagcagaagcgcaaaaaacggcgcaggacctatgaaggccagaaaatccagaatttttccgaactcaaggtaggcgactatgtcgtccatgaaaatcacggtctggggatctaccaggggattgagaagatcgaagtcgacaaagtaacaaaggattatatgaagatttcttatgcaggcggtggggcgctgtatattctggctacccagctggatctgatccagaagtatgccggtgcggatgcgaaaaaaccgaagctgaacaagctgggcaccagccagtggacaaaaacaaagagccaggtgcgcagggccgtcagggcagtggcaaaggatctggtggagctttatgcggcaagacaggagtcccagggatttgtatatgaaccggataccgtgtggcagaaggaattcgaggagatgtttcctttcgaagagactgatgaccagctgcaggcgattgcggacacaaagcgggacatggaaagcaaaaagatcatggaccggctgatctgcggggatgtgggctacggaaagacggagatcgcgatccgggcggctttcaaggcggtacaggaaggaaaacaggtggtctatctggtaccgactacgattctggcccagcagcactacaatacctttgtgcagcggatgcgggattttccggtcagggtagaccttctgtgccggttccgcacaacggctcagcaaaagaagacagtggaggatttaaaaaaagggctggtggatatcgtgatcggcacccacagagtgctttctaaggacgtacagtttaaagacctggggctgctcgtgatcgatgaggaacagcgttttggtgttacccataaagagaagatcaaaaagctccgggagaatgtggatgttctgacgctgaccgcaacgccgatcccgaggacgctccatatgagcctgatcggaatccgggatatgagcgtcctggaggaggcccctatggacagaatgccgatccagacctatgtcatggaatacaatgacgagatggtccgggaggctatagagagggaactgtccagggacgggcaggtatactatgtttacaaccgggttagtgatatcgcggatgtggcggggagaattcagaagctggtgccggacgcagccgtttccttcgcgcatggacagatgaatgaacgccagttggaaaacattatgtatgattttatcaacggggatattgatgttctggtatccacaacgatcatcgagaccggactggacatctccaacgtgaacaccatgattatccacgatgcggaccgcctggggctgtcacagctgtatcagctccgggggcgcgtgggcaggtccagccggatggcctatgcatttttattgtacagaagggataagatgctcaaagaagtggcagaaaaacgccttgcggccatccgggaatttacggatctgggttccgggtttaagatcgcgatgcgggatctggagatccgcggagcgggcaaccttctcggggaagagcagcacggccatatggaggcagttggatacgatctgtactgtaagatgctcaatgaagcggtgaagcagctcaaaggcgagatggaggaggatgtttacaccacaacgatggacctcaatattgacgcttatattccggaatcctatatcccgaacgaatatcagaaactggatatatataaacggattgccagcattgagaatgaggaagagatggatgatatgatagaagaactgattgaccgttttggggatattccaaggaaggtgcagcagcttttgaatattgcaggtctgaaagcgcttgcccattccgcctatgtgaccgcggtcgagcagaaaggggatgcttatcagtttaccatgtatgaaaaagcgaaggtacagccgcagaaaatcccgggccttttacaggcctatcatgggagcctggtgttcaaagcagatgatcctccgtacttcctgtaccagaagaaaggacgcagcggacgggagaaggatgagaacgtgctggaattggtgaaaaaggtgttaaatgacataaaaggcttgttagaataagaaaaacaagctataataatgaagttaaaatgtacgtaggaggatgttatgggacagttcagaaaaagagtgatgataatggctgctgcgggccttatcgcggtatcttccctggctgggtgcagccgctctatgaataatgatgccgtagttgccgaagtaggagaagacaagattgtgctgggggttgccaatttttatgcaagaatgcagcaggcgcagtatgagacatattatgccgggatgatgggtaccaccggcgaggccatgtggacacaggaagtagaagagggcaagacctatgaggatacgacaaaggaaagtaccttgaaagcaatcgaggacatgtatctcctgaagcagcacgcggccgattatcaagtggaactgaccgacgatgataaaaaggcgattaagaaggccgctgaagcctttgtggaagacaacacgctggaggacaaagaggttgtttccggttacgagaagtacgtcaagacatttctggagctggcaaccattcaggcaaagatgaatgctccgatgaaagaaggcgtggacgaagaggtttccgacgaagaagcggcgcagaagagtatgcagtatgtgctgttctcctataataagacagatgaggaaggtaattcagaagccatgacagacgatgaaaagtcggccctgaaagaaaccgcagaggagtttgcagaagacctaaaagatagtgacggtcgggatttggaggcagcggcatccgaagccggtctggaagtacagacagcaacctttgattccgaatccacatcgcccacggctgacctggtaaaggcagcagatgcgctggaggaaggcgatgtaaccggcatcgtagaatctgacaatggaatctacgtagcaaagctgaccagcaacctggacagggaggccacagacgccaagaaggaatccatcgtggaggaaagaaagcaggaacagtacgattctctcctggaacagtggagaaaagatacaaagataacagaacatgaaaaagtatggaaaaaagtaaaatttgaaaagcagggtgtgaccataatgcagagcgaggatgaataggtaacgggttttcgtcttgttggcaaatggggacgcttcatgacagccccagtaccttcccggcagccctgtcatgaagctggttcatccaatcgggaggataatatacattcatttggggcctctgggcgggagcagcggatgtgaactggctatgcgcagcgtgttttcttcggtatgcttttgtctgtccccgtctcgttcaacgctaggcttccccccatcaaaaaacattttatacttgaagttttcttgatgtgatggtagaatattaagagttcgtgagggagtaattagcgtagtgcatacgtggtaagtcaacatactggccgaggaggtctggcttatcttaattaatgagactcatgtacagtttatttgctgtacatgtgtctctttttatgttgcagcgcaggctggcacgtgggaaggttcacaaaggaggaagatgacagatgggaattcttgaattgtttttattggcggtaggtttatcaatggatgcttttgcggtgtctgtctgtaaggggctggcgatgccaaagattaccgtgaaaaaggcttccgtggtaggggtgtggtttggtggatttcaggcgctgatgccgctggttggttattttctaggggtgcagtttaaagataagattacggctattgatcattggatcgcttttattctgctgggcatcatcggatttaatatggtcagggaggcgctgtccccgggctgcgaggcggccagtgatgagctggatgtcaaaacgatgttcgttcttgctgttgcaaccagcatagatgcactggccgttggtattactttcgcttttcttcatgtagatgtgatatcagcggtctcctttatcggagtgacgacctttcttttatccgcagccggcgtgaagattggaaatgtctttggaacaaagtataaggcgaaagcggagctggcggggggcgtaattctgattctgctgggattgaaaattctgctggagcacctgggggttctgtaaatcagaaatcccagctttcccccagcttttctcgcgcaacatatagggtgcggtcttctctggtgcgcagcgtccattttaccagcgtcaggcgccggttttgaatttcaatgcaggtgatgcacctggggtgtacacagctgccggtattgaagtagggagaggcatccgatccggtcatggggcggtgggtatggcctgctatgagtactttctgttccctgagcgcccagtcggagagacgcttttctacttttttcttcctggaataattcctggcggcactcgttggatcggagaccccaagcgcctccagcggtttccagaggtaccgtacgagaaatcttgcggccgcgctgcccgtactgttcagaaaatcagcctggtgtccgtgggtcagatacagatctctcccatgttccatatcttttaatatcatcccctgaagatagcacatatcaggaaagagagggacttcgtccgcctgtccgctggcatggtatgtggagcagtgctttcggcagtagccgcagtggcgtttgctctgatcatggtttccgtaaagcatatacagccgccccttgtttttaaattcccggagcagccagaacacattgctgtgaatgtctataatcctggaaaatgacctgttttcccacaattcatctccgtcacccagttcaatatatgaaaatcccctctcataatagtaatttagggccgcaaaatagaggttctgattctttagaaaattgtcgttgtgatcgccggttccacgatgacagtcgctgatgagcacaaagcgggaggtgctgtataagggaatctccaatgcgtctgaaaaggcacgggaaatcctctgataccagctcatgagtgcctcctggttctttttccgattctgcggatgcgaagtgtcttccgaaatagaaaaggagacagataatagaggaaaagaagcctgtcagcagtgctgtaaaatggcctggttatccagaggtacagccggcaggcaaacctggatttccacaatacatagctttgtacccaggtatcccacgggacgcccggcaccttggggtcagtgaggtaaaattgtacggtagtgccgtaggccaggatttcactgtctttatagcccagcccaatgagggcacgggtaaaagcgcggcacatagattcctccggaaaagtcagtaccgcctccagtagcagatcctccggctgcgtacaggtacccatgacaaatccccccggccgccagtgagtctgggacagattgaaaaacggacattctggtcccatcagcctgagccggacaggcagcatttcatccggttctgcggctggaaagattgtctggcgccgcagcgcaggcggtacgatggtatctgcatggtagattccagcctcggctccagtactgatcccatactgccccttccagaactcgatcagccaggtctttccccgataattaaagtagacgggctcacggtcaaaaaccatgtttgcagacagggctgtctggtcgtaaaattctccgcagccggattctttttgccacgcgtccgtactggtagtaaaaatatcctgtacaaactgatatgtgaagccgaaaggctccgcgagttcatttaggagactgcattttttcgtgcaggacattttccggacctttgtcaggctccgttttctgcggatgcagaaaaacgcgcaaagtaagagcagtattacaatgaaagaagtgatgataagatacatacgcaaaatcctacagtgattcttcctatattatatgcaaaattctgtaaaatggccgtaaaaccttgaaatttggggaaatcccatatataatacacgggttgtggatatgacaggaacagtgtgcagcgaggaatcaattgaggactttactgaagggagaagagcgaatgggatacgactatgggaaaatctgggttgcaggcgcgtccggacgtgtaggtacgatgatacacaatatgctggatatgcgggatgttgaactcctggagacagatgtggaggaactggacattacttgtgcagctgatgtgaatttgtttggcagcagaaatcgtccgaacacaattattaactgtgcgggaatgacggatgtgcaggaatgtgaggataatatagaacaggcctacaaggtaaacgcattgggtgcgagaaacctaagcgctattgccagaaaaattgatgcaaggattattcagatatcaacagatgatattttctgggataacagctgcaggcggtttcacgagtttgatacgccaaatccgagaacggtctatgggaaatcaaagcttgccggggaaaatttcgtcaaagaactggcacctaagcatctgataattagaagctcctgggtatatggaaaggaagggcataactttgtaaattctattatagagcaggttcaacgcggcggcatcatcgaggcagccgtcaatgagtatgcatgtcccaccagcgcaagggagctgtgcaaggtaatcctgcgtctgatccaggaggagcaggaaggaatctaccatgcagtctgcagcgggtcctgcagccgttatgaactggcgcaagagatactgcggatcatgggcagacaggatgttaggctggaaccggtagaactgggagaccctggacagattcctggcgggtccgcagcaaactgcggaataaggtatacccaaagggcatcccgtaactcatgccctgcgggcggatccgcagtaaactgcggaataaggtataccatcctggataatatgatgcttaggatgtgcggaattgaagagccggaaccgtggcaagctgcactgaaagagtatttacaggagcttaacctgcaggaaggagcggaaatttaatggaagagacaaagaagaaaaaatttgggcttacgacattgattttcatcagcctgctgctcggtgctgcggcagggattattctccactatctggtgccggcaggctataccagagataccgttatcattaacgggatcttttatgtggtcggcaatggatttctcagggccatgcagatgctggttgtaccgctagtgttttgctctcttgtctgcggcagtatggcgataggggatactaagacgctcgggaaggtgggcgttaagacgattattttttatctgtttactacggcagcggcgatcacactggcactggggatcggcaatctgatcaatcctggagtggggctggatatcagcagcgtggaaaaaacagagacagcagctgcagaggcagtcagttttgcggatacgatcctggaaataattccgaaaaatccaatacagggactggcggaagggaatatgcttcagattattttctttgctatatttgtggggattctgctggcaaaaagaggggagcgtgcggcgtccgtgtctcagttttttgcccagttcaatgacctgatgatggatatgacgatgacggtgatgaaggccgccccgatcggggtattctgcctgattgcaaagacctttgccggaatcggattcgatgcattccttcccatgctcaaatatatggcggcggtatttttggcgctgctgctgcaggggttcggtgtataccagatcctgctgaaaatatttacagggctgaatcctgttaaattcgtaaaaaagtttctaccggttatgggattcgcattctctacggcaacgtccaatgctaccataccgctatccatagaaacgctggataaaaaaatgggagtgtccaaaaagatatcctcctttacgataccgctcggagcaacgatcaatatggatggaacagcaatcatgcagggggtggctgtcgtttttgtgtcccaggcctttgggatcagcctgtcgccggcggattatattacggtgatcgcaaccgctaccctagcgtcaatcggtacggcgggagtgccgagcgtaggtctgattacactctccatggtgttcaatgcggtcgggcttccggtagagggaattgcactgatcatgggcattgacaggatactggatatgacgagaacggcggttaacataacgggggatgcggtttgcacaactatcgtggcacatcagaataaagaactgcgcagagaggtcttcgagaggggagtttgacgcccagcggaccgcaagaggaaggatgccttgtgagatgcgggacagaatgcgcggcaaggtctgtgctgttttgcagggcgacccgcaggcgaaccagcagtaggagaaaaaagacaggattgcagagagccagagacattcaccgctgaagctgatgcttaagcggctcaggtctctttggaaattgctttggcgagcaattcccatctctgcaatcctgtctttttttcttactgctggtaagcctgctctacgccctgcaaaacagcacagaccttgccgcgcattccgtcccgcatctcatagggcatccttcctcttgcggtccgctgggctggtgcatcctggcgggagtgggagaggcggattgaactgggggacggggctgtattggactcggacgggctgtttagctatctttgattgcttatcttcaggcggttaaatactttgtttatatgtattctaatttttcaaagtagtgcatcaggatgtcggcgcagttttctactcctagttcggaggtgttcagaatcatgtggtagtcgtttacgtcgccccaggttttaccggtgtgctcgtagtagtaggcggctctttctttgtcggtactctcgactttttctttggcctcctcgtgggtgagggattccagctccatgatgcgggatatacggtcttctttgtctgcgcagacgaaaatgttcaggacgtttaaacggtctttcagaatgtcggatgcgcagcggccgagaatgatgcaggggcttttggcaagttcgcggattgcttcggcttctgagtcgtacattttgtcatctattgtatgttcaatgtaggctttgtcgtataccgggatgtccagtcgctgggacagctcatttgcaattatgcttgctccggtaccaaaacggcggctcattgtaattattaatttcatagtttttcctccttcgtgtatacacttgggtttggcttataggtctatgtgtttccttattataacactgatgtgtggaaaagtgtatattttattgcttagaaatcttagtatttgcgggagggggacgctgagaaaaaggggaggaaggtttctgccggggctgtatatgccgtttcggaaaccggccgcccgctaagaatccgtagaagaaaaagcgggaaaaacagagggatcagcggcatgcaacccgaaatttgataatttcgggtcttaggccgcctcggaatttgatgcggacatcaaattccgccctctgtttttcccgctttttcttcaacggattctaatacggactttaaggcttccgaaacggcatatacagccccggcagaaaccttcctcccctttttctcagctggtgcatccgggcggtaggatctaatttccaagaagggggaaatccgggagtggcttatgtgtgtttctttggtgttgctttatcttccggggggggggggtgaatgaatgatatgtgaaagaagtgcatttttaagaatatggaagtgcattttttaagaatttggtgttgtgataaatggggagggaggttataatggggctgtgacagaaatcagcggaaaggcgggaaggacatcgtgaagaacaggaatcagagagcagctgtggttgttttgattgtttgtatggtgttttttgcggctttggagagcgttggcggatttcggacgggctgtcggaacgaagggggcggcgtgctacagtctgctgctgtttcgggaaacgatatatgtgcagaacgtttgggagaaggattccgggctggcggatgtggatatgcggggcagaggatggacgcgggagacagcctgcgtacggggagtttggattttatgcctgcttcggaagcgaaggatacggtttttgtgcgcggcggcaggatggatgaggattctgcggagccttctttgttttttgttgaagtctttcttatattaagtgtttttcaatttcttctggatggcagaacgtggtctgcggttcagtctttttgcatgggttttcaaaattatgccatgcttcaggttcatattatccagcagcgggacgggaaaaagggccggctttcttattctttttcataatgagtgttcataagtgaaaatagggaggatcctcaggggatcatctggttgaataagaggaggcttatactttgaaagaacataaacgaaatatatggattgtgctgtgtgtaaccgcagtgtttctttatgctgccattttcggactgggcagtgattttaagggtgcggtagatatgcgttttgggattgatatacggggcggtgtggaagcggtctttgagccggagggtgtgacagagactccgtctgcagaggatctggatgcggcgagaacggtgatagaaaaccggctggatgcgcagaatattttggacagggaggtaactgcagacaaggagcatggaaatattattgtacggtttccatggaagtcggatgagaaaaaattcaatccggaggctgccattgctgaattgggtgagactgcgaagctgaccttcagggactctcaggggaatgttctggtggaaggcaaaaatgttgcagacagcagtgtggttaaaaacaagcagacaggagagtatgaagtttctcttgaatttgataagcagggggcagaagactttgcagatgccacggagaagctggtcggccagtccatgggcatttatatggatgaggagcagatatccaatccagtggtcagggaagcaatcaaaggcgggcaagccgtgatcaatggcatgggttctcaggaagaggcggaaacgctgtctgaaaaaatcaatgcgggggcgctgccgttttcgttgaagacgacgaattataacaccatcagccctacgctgggaagcggggcactgaaagcgatgacaacggctgcggccacggccttcattctggtttgcatttttatgattttatattaccggctgccggggacgatcgcctgcctggcgctggtatttcagatgagcctccaggttctggctttgtctgtgccccagtatacattaacgctgcccgggattgcagggctcatactatccctgggaatggcggtggatgcaaatgtgatcatcagcgagcggatcggggaggagctgcagaaaggctccagtatccggacggcagtgcggcgcggctataagaatgctttttcctctgtactggacggaaatgtgacgaccgcagcagtggcagtgatcttgatgatttttggctcgggtaccatgctgagctttggctatactctgctgacgggagtactgatcaatctggcagcaggcgtatggctttccagggtcatgctgagttctgtgattctttatccgggattccagaagcttaagttgttccgtgtgaaaaaggagcgtaaagtaatcgactttctcggcaagcgtaaagctatctttatattcacggtatctgtgctggctgccggaagcattataagcgcggtgaggggtgtaacgctggatacacagtttaccggcggggttattttaaaatatacctgtgagggtgcgccggatacggaaaaagcttctaaggcagtcgaaggcgtattagatcgtcctgtcagcgcccaggcgggagaggattttgtgtcggggcaggagaagctggttttgaatctgggaggcaatcagggcatttcgccccaggagcaggaaaaggtgctgcagcaattgcaggcagttcagccggaattaaactatcagtcatcggaaacctatgcggtggaaccgtatatcggagccagggctctgaaaaattctgcaattgccatcgttttggccgctctgtttattgttatgtatatcagactgcgtttttccgcgctgtcgggcttttctgcgggagtgtcgggggtgattgctcttctgcacgacgttttcattgtatttctggtattcggagtttgtaaaatacccttaaatgatgcgtttgtatcagtaactttgacaataatcgggtattctattaacgatacgatcgtactgtacgacagaatacgggagcatatgagcggccacacaaaagaaggcctggttccgcttgtgaacaggagtataacggaaacattagggcgttctgttaatacggcgtttactacggtgctgtgtgtggcaattgtactggtgtttgcaatcttttataatatagaatctataaaaatatttgcacttcctatgctgatcggcatgatcagcggctgctattcctcaatctgcgtagccggagcgatctgggttacctggaaggaacggaaaaaatcttaatatttgcgtaatataatattaataagtttccatcctgttgcgaaaaatgttgaaaaatgctattatgttttggtatgtaacttagttttgcatatagaaagcatataaattattgaaataagataaagaaatggaaggggcataccgatgggccagaataaaatgagcgatagcgaaagagaggcatacaggagagagcaggccagacagcgccgcaggatggaagaaaagcagaaaaagacagtacaggggaatccggccaaatctgtggccaaaggaggcaaaagcggcggtggtaagaacaaagctgcaaggccgggaatcgacggcagcagcaggaatgcggcaaacggcggcagaccctccgggggcacaggtaaaggcggaaacggcaaaaaaggcgatttcggcaggcgtccggcggcaaacaaagtgagcaggcaggtagggctcgtactctgcgcagttcagctggctgtaacgctggtgtttatagctgcattgtttgtgctgaatatgctgcccatgaaatatctggggattattattgcggttcttgtattactctgggtacttccgctgtcaagccagttgatatctaagaaaaaagcaattgccggaaaagtgctgagcgtgctgatgtccatcgtgctgattttgggatcctattatatattcaagacaaacggaactgtaaaggacattagcggcggcaataaaaaagtcgataagatggttgttgctgtactggcagaagacccggcagaaaacatcaaggatgcatccggctacgactttggcgtgcaatacgcgatgaaaggcgacgatgtgaaatctacggtggatatcattaataaggaagtgggcagcagcatctcgacggtagaatacagcagcctgaatgagcaggcgcaggcgctgcatgacggcgccgtggaagcgatcatttacaacgatgcctatacggctattctggaagaggcatttacaggatacagcgacagtgttaagattatttacacccatgaaataacaagcaagctggagaatactgcggctgacgtaaaagtagatgatgactgctttacggtttatataagtggaatagatgtatttggcgcgattgagactaacagccgaagcgatgtgaatatcattgcggttgtcaatccgacgacgcatcagatcctgcttgtaacgacgccgcgtgattattatgtagagattccgggtatttcgggcggacagctggataaactaactcatgcaggaatttatggggtagatgcatcaatggcaacgctggcgaagttgtacgatacggatatcgacttttatgcaagagtgaactttacatccctggtacagatggtagatgcactcggcggtgtggatgtcgtttctgaacaggaattcaacaccagttatgattcaggccttgaaatgtatgtggcccagggagttaatcattttaatggacagcaggcactggccttctccagagagagacagaatgtagacggcggggacttccagagaggaagaaatcagcaggccgtcatcactgcgatgatcaagaaggcgatatcaccggcaatcctgacaggagcaaacggaattctgagcagcatcagcgggaatgtagatacgaatatgtcccaggagcagattcaggagctcattaagagccagttgaatcagccgtccgcatggaatatcaaatccatgtcggcaacgggaaccggagatgatcaggaatgctattcctcaccgggaagcatcctctatgtaacgcagccggatcagaattcaattaacgagattaaacaggccatcgacgcagtggaggcaggagaaacgctgccggattctgaagtggcacaataaaattctaaaataccgaggaaaagaatatgatgaaactgttaaaaaagtgggatctttcgattatctataaagcattgcttgtgattttggatatcgtatttattaatgccagttcctttctggcattgtggatccgcttcaatatgcagatcagtgagataccggccgaatactatacttctgtgttagatttggtcgtagttaatacgattgtgaccgttgtgatctttgctgcctgcagattatatacaagcctttggagatttgcgagtatcaaagaactggtatatgtgattgaagcctgcctcgcatcggttttgtttaatattctggcctattatctcacttacaggaccatatacaggggatattttcctctttatgtggttgccttgtttctgctgacatgcctgagcaggttttcatacaggctggcaaggctgttgtaccgggggaacattcacgggaggcatgtccgcaatactatgattatcggggccggcgaggcctgcaatgtggtgatgaaggaactggagcttagcacggagctggatgcaaagatctgctgtgtgatcgatgataatccaagaaaacgcggcacatttatccacggtgttaaggtagtgggcggaagggaagaaatcctgcatagtgcggaaaaatacaggatcaatgaaattatcattgcaatcccaagcgcagataagcgggagcggcagaagatcctggatatctgccagaaggtgccggattgtgagttgaaaattcttcccggagtataccagctggtaaatggagaagtcagtgtgtcaaaactgcgcaatgtagagattgaggacttgctgggaagagatccgattcggattacgacggagaaaatcgggcggtatgtgtccggcaaggtcgtactggtgacaggcggaggcggcagcattggaagtgagctgtgccgtcagatagcggcaaacggtgtaaaacagttgattatttttgatatctatgaaaacaatgcctatgatatccagcaggaactgaaagcaaaatttccgtatctggatctcgtggtgctgatcggatcggtcagaaacggcaggaaggtaaatagtgtttttgcccagtaccgccccgatattgtctaccatgcggccgcgcacaagcacgtaccgctgatggaggacagtcccaatgaggcgatcaaaaataacgtctttggaacttataaggtagcgcttgcggcggacaggtacggcgttgataaatttgtgctcatttctacggataaggcggttaatccgacaaacattatgggcgcctccaagcggatgtgcgagatgattatccaggcctttaacaaccgttcaaggacagagtatgtcgcagtgcgctttggtaacgtgctgggcagcaacggcagcgtgattcctctgttcaagaaacaaattgaagctggagggccggttaccgttacacacccggatattatccgctatttcatgacgattccggaggctgtatcactggttctgcaggcaggggccagcgcaaagggcggagaaatctttgtgctggatatgggccagccggtgaagattgtggacctggcaaagaacctgatccggctgtcgggctatacgcttggagtagatattgaaattaagtatactggactgcggccgggagagaagttatatgaagaacttctgatggcagaagaaggtctggagaatacggaaaatgaaaaaatacacatcggaaagccgattgaatttgatgaagaagaatttttaaacgatctggaagatttatatcgtgaggcgtatgcggagacagaccgtatgaaatatattgttcacaagattgttccgacctatcatctgcgggatgcagatattatcagggatcagcagatacaggccggatggaataaagaattttcagatacccgttccaaactgcccagcgcttttttagacagagggattgcggatgcagatatacggacagacagtccgaaatccagaaaaaaccgatcatgacaggaaagaaggcacaaaatatgaaggtaccattttcaccaccggatattaccgaagaagaaattacagaggttgtgaagaccctgcaaagcggctggatcactaccggtccgcggaccaaggaattcgaacgcagaatcgcggaatactgcggtacacgaaaggctgcctgcctgaattccgctaccgcctgtatggagatgacactccgcgtgatgggaattggagcaggagacgaagtgattacgactgcatacacgtatacggctacctgcagctgtatctgccatgtgggggcagttcctgttttagtggatacgctgcccggatcctatgaaatggatcctgaaaaagcggcggaggcggtgacagaacgtacaaaagcaattatatgtgtggatctggccggaattatttacagcaggtacgatgaaatattccgcattgccgaagaaaaaaaacagatataccggccttcaaatgagcggcaggaagcgcttgggcgtattcttgtaatggcagacgccgcccatgcctttggcgcgcgcagggagggcaaaatgtgcggagagattgcggattttacctgtttttcatttcatgcagttaaaaacctgactacggccgagggcggggcagtgacctggtccgatacaatacagaaggcaggtctggatgcggaaggactatacagggattatatgctcctttcccttcatgggcagtccaaggatgcgttggcgaaaacacaggcaggagcgtgggaatacgatgttgtggcgccttattataagtgcaacatgacggatattatggcggctataggactggtacagctggagcggtatccggagattctggagagaagaaaaaaaatcatcggcatgtacgatgtagggctggggcagagcccggtgcaggtgctgacacactatggagagcatcatcagtccagcggacacctatatcttgtacgtgcgcttgacaaatcacgtgaagagtgtaacaatattatcacagaattggcagaagctggaattgcatccaatgtccactacaaaccacttccgatgctgaccgcctataagcggatgggatttgacttggaggactttccgaatgcttatgcacagtttgagaatgaaattacgcttccgcttcatacatgcctgactgatgaacaggtgcagtatgtgtccgaaacatttcgggcgctgctatgagcgcagatatagcattacgatagaatagagatccaatgtgaaaagtcctccgggacttgagatatgatgaaggatgtattagaatgttatgacagggcaaagcagccgttattcttacaatcaggagtaaaaagaatgatcagatgggaacagctgccggattcaatgaagaacaagacactccggccttattatgataaattgaaaaagaagaagattagtctgtgtatgaaacgcatcatggatcttctttttgcattagttttgaccgttgttttagcgccggtcatggctgtgcttgcactatggataaaattggacagcagagggcctgtcttttacagacaggagcggattacacgatatgggaaaccatatcgtattttcaagttcaggactatggtcgcagatgcggatcaaaagggacctttagtcaccggcaaggcggacagccgcattaccagggcaggaaagatgctccgcaaatgcaggctggatgagctgccgcagctttttaatgtacttaccggggacatgtcttttgttggaaccaggccggaagtaagaaagtatgtggagcaatataccgaagagatgaaggcaacgctcctccttcccgcagggatcacatcccgtaccagtattatcttcaaggatgaggatttaatgatggaaaaatatctgagggagacgggaaaatcggtagacgaagtatatgtggatcatatacttcccgtgaaaatgaaatataacctgcagtatctccggaactttcatttctggggagatatcagggtaatgatagatacagtactcgcagtgataaagtagagggggatatacgatgaagaagatagcagtcattacaatgggggtaagactggacggagaaaaaggctatacccggtttcgctacctttgtgattttctgacagaagcgggatatcaggtggatttgataacgaccacattccagcattgggaaaaatcccagagggatatggaaaagattaaaaaagaggattaccagttcgggatcaagtttatatatgagccgggatataagaaaaatgtggatctgaaaagaatccgcagccataagatcgcagcaaagaatctgacggcgctgttggagaaagaaggggactatgatcttctctatgcggaaattcccccgaatgatgtggcgctggcggcagccgaatacgcaaagcggcgggggattccatttgtggcggatgtaaacgacctttggccggaggccatgcggatggtgctggatattcccgtgatcagttccattttattccatccactgcagagagatgcagaaaaggtttattccctagtatcgggagtcatcggcacatcggatgaatatagagacaggccgtttcagaaccagaagagggaagtgcctaaggccacggtttatgtaggcaatgagatctcagaatttgataaaggcgccgaggagaatgactctctggttacaaaggcagaacgtgaattctgggtgagttatgccggtacaatcggaaccagctatgacatacgtaccatggtgctggcagcggaagaattggcaggaagaggcaggcaggatatccggatcaagatactgggcggcggaccaatgaaagatgagttggaagcgctggcgcgggaacgccagatctacaatgtagaatttgttggttacgcaccctatgataaaatggctgcttacctgaaaaagtcggatattctggtcaattcttttgtaagaaaggctccgcaaagcattgttaccaagatcggtgattatcttgccgccggcagggcaatgattaatacatgtatgagtcctgaattcagaagaaaagttgaggcggacggttttggcgtaaatatcgaaccagaggatgtcaaaatcctggcggatgccatcgaagatttgtatgagaatgaagaaaagcgcctggaaatggggaaaaaagcaagaaagattgcggaagaacagtttgacaggcccaaatcatacagaaagatagtagagttaatcagggaactgactgaaaagaagtaaattgagaggtacatttatggataaaaaagaggcaaaaacgccttatttttctatcgttatgcccgcctacggtgtggagaaatatatagacagagcgattcaaagcatacagaatcagacatttggcaattgggagatcctggtggtagatgactgtactaaggatggaagcggaaggattgcagaaaaatacgcctcggaggactcccgcatccaggtgatacgccatgaggtaaacaggggcttgagcgcagcacgcaataccggaaccagggcggcacgcggagagtacatctggtttatggatccggatgattatgtggatcataccctgctggcgcaagtgtatgcctctatcgggaaaaatccagcgcaggtagtgctgttcggtcatattgaagaatactatgataagaaggggcatctccaatatacacaccctatctgcccagaagaacattattaccggtctgctgaagaattccgtccccatataatagagctggaacaacagacactgtatgggtatgcttggaacaagttttatctgctttcctatatccgggagctgaggctggattatgaaaatgtcaggctgatcgaggatatcgtctttaatattaaatattttatggatatagaaagaatgaatattctgcccattgtgccgtatcattacggcaaaaggatggaagccaacctgacgaataagtttgtaccggattattttaaactccacaggcagcggattgagatgctgtttgaccagttttcctactgggggatctgtacggaagcagtcaggagtgttctggggagcttgtatgcaaggtatattctttccgctctggaaagaaactgtgacagacgttcaggcatgaatcatgcacagcggtataagtggtgcaaaggggtgtttgcccagggcctgttcaatgaattgattccgatggcacgggcaaaggaaagcgtgacacttcggactgcactgatgctgttccgctggaagaaagcaatcccatgtttgatgatggggagggggatctatatggtaaggagatttctgcctatggtttattcgagggtgaaatcaggacgttaatgtgttttaaaaataactgcaaggagaattatgacagagaataagagatttaaacaggtactttttatatttaagatgtattatatgatttatttactgctggctttcaatgcctttgtaaacggcactgtatggatgaaatatgcgacgatattatcggcggtctggggagcggtgctggggctctggatgctgaaggattaccgcctgtatctaaaggttccgaatctttggcccctggctgcgttcttactgagcgcggtattcagcgcggttatgaatataaggtatggatatctggagaatatagaaggccttgtatggatgtttatctctttatttattatatatataccgacctgtacgtatagcagggaagaggtattgaaggaattgaaaattacggcggtggtatatgtagtttactgcaccgttgttcatataatcagcctttctatggtatattggggcagaaatatgggatatacagaccctctggggacagagcatattgtagggttcaactgggggcggctttggggaatctacgacgaacccaataggggatctgttattgctctggcagcagtttttctggcagtctatcttttctggatatccaaaaggaaagtcgggaaagtattctgggttttcagtatcattgtgcagtttcagtttcttgtgttttccgattccagaaccggggaagtagctttggctgctggtctgtttgtaatggcaggtctctgtctgtaccgccggtttggaaaatgcagaggaagggcggcggcagcgttcgctgcggcgctggtgatcggattagcagcagtggcgggaaccgtgggattcaaacaaatttataatacagtagataaaaaaatagaagcagtccacaaggcaaagaaaaatattccaaagaagagcatctcaggacggaaagcgatcggacggaaagatgatcttgcaaatgacctgagtaatggcagaatgggaatttgggaaagcggtcttgagatcataaaggcatctccggtatacggcaccagttaccgcaatattacggaatttgcagaggatcagtttccggaaacatatcttgtgaagaattctttaggtataaaatatgactctatgcacagcatggtggtggatacagctacggcacagggagctttgggtatagcagcgcttatatggctcatggttaatacactgttgtatatgaagagaaaggtaaagggagcggcacctgatatcttcaggcctgcggtggccgttttcacggtaatggcttccatttcggcggcggccacggtgctttccacgatcttttatgtgaattcaccggagacatattgtttttggctgtgctttggatatttcattgccctgcttcaaacagggcataaggaagaggcaaaatgaaaaaggttttaattggctttattatggatggcacaggcggaggaattgatggatatctgctaaactttctggaaaccgtcgggggagaggatgtgcagatggactttcttaccaaccatatcgatgaggggctgcggcagcggctcgaaaagtatcattcccgtttatttgagattcccagcctgcaccacccttttaagcagtatgcgagagtgtgccatttgatccagaaaaaccactacgatattgtttatttaaatatatctacggcaatagattgtgtggcagctctggcggcaagaaagtgtatggtaaagaaacgggttctgcattgccatgccagtggtaatgactgttcaaatgcactgaaacgtctggtttttaacagcattcataagatatgcagactgtttttgtaccggacaggcaccgagtactacggtgcttccagactggccggagagtgggcatttccgagaagaatcgtagattcggatcgttttcatgtagtagtgagtggaattgatacccaaaaatatatgttcagtcagtacatcagggatgacgtgagaagggaactgcaattagaggactctttcgtggtcggtcatgctggtacgttcacctatgtgaaaaatcatgagtttcttctggaagtattccgggaaatctataaaaaagattccagggctgttcttctgctgatcggagcaggagaggaattggaaatcataaaaaagaaggtgcggcagtatgggctggaaagtgcggtgcgtttgacaggctggaggaatgatgtggacaggctccttcagggcatggatttttttgttcttccgtctcattttgagggcctttccatgatcagtctggaagcacaggcggcggggctgcgctgtgtattaagcagcggcgtgcccgaagaggcaaagatcagcagggaatgttattttcttccgttaagcgcaggggctgataaatgggcagaatttatactagctcacagggaatatgacagaaataacgtaaaaatagatatggacggctgcttatttgaccttaatgcccagaaggctgttctgagaggaatattatacccaaagggcaccccgtaattcacgccctgacgggcggtctgcagcataactgcagaacaaagtatagaatggcggcagctattcctggatttgaactgctgtgaaccgtaaaaaactggtgataaactttgtcaggaagtgaggaaatatacacatggtgttggtaagtgttgtagttcctgtgtataatgtgcaggattttcttgaaaagtgtgtaaaaagtataaaagcacagacatatcaggagttggaaattatactggtggacgatggatccacggattgcagtaatgagatgtgtgacaaatttgcacaggaagactccagaattcgggtgatccataaaaaaaacgggggactgagcgatgcgcgaaatgtgggggcaggactggcggcaggaaaatatctttttttcctggacagtgatgactatgtggacagcaggctagttgaaaaagcggtgggggcagcagaaaaatttgacagcgacatcgtatattttgattataaacggctggaaccaaacggggatgttgaagtatgtgactgtaatctcccggagatgtgtcctatcagccttaagacgaacccggagctgatgctgcagacactttctgtgtgtgcgaaactgttccgccgggacttttttacaaaaacaggattgtttttcccggtaggataccgctacgaggatctgggtacgattcccaaattagttctcacggcagactgtgttgtatatttaagagaaccgttgtattattatatgataagggaaggctctattaccaccggcacggaggacgaaaagaattactcccacagaaaaaaaatggtggagggggttctggactattatcgggaaaaaggacagtttgagactttccacagggaactggagtatctgacattttataatatgtattttattcctgccagggaaatgatatatcatgacaggaaaagtccctatgtgaaaaagtgtagggatttgaccgtaaaactatttcccgggtttcgaaagaatccttatataaaaaatatgggcaggaaagaaaaagtacagttctggatactggaaaaacggcagttctggatgatgaatgtactgtcctgggcgagaaaacagtcggacaagatgagaagacgataggagaaaagacaatggataaggtattatcagtagttattccatcatataatgtggaacgttttttaaggcagacactggattcttttctggataaaagagtattgaaggatatagaagtgttgattgtagatgacggctcttcggacggtacggctgcaataggaaaagtatatgagaacagatatccggacagcttccgcctgatttcgaagaaaaacggcgggcatggttctacaattaaccgggggatagaggaatccagggggacatattttaaagtcgtcgatggggatgactgggtagatacagagggatttgtctgtatggtggagaaactgagaacgtgcagcgcagactatgttgtatgtaattattatgaggtggacgatcagacaaaagagaggacaccgcgtgagtttaaaatgctgcaaagggaacagggcagcggggaatactggaattttagtgagattgtcacaaggacacagatcccaatgcattcgctggcaatccgttcggcaattctcaaggaacatcatatccggctggatgagcactgtttctatgttgatgtagaatatattttgtatccggttccttatgtggaaaaggttgctttttttgatatttatgtgtatatgtaccgtctggctcaggcgacacagagtgtcagcatgcaggggtatcagaagcacatacagaatcatatagatgtgatcatgcatctgacagattttgttacggaatatgcaaaacaagaggacagccaaaaagaaaaaatagagtatatatcaaaacggattgcggagatggtaggggagcagattacgatcttcatgagttatccggttgagaatgaggagatgaagcagaagtttatagaatttgaccaagaactgctctctaaaaatcctgagatatacagactggcggggcaggagagcgggacattaagtcttttgcggcgcactgggttcaggggatataagacaatagtgaaaatggggaaaaaaagaaacgggatggaaggataacaggcattatgagaatccgttcagtaaaatttaacttcataatgaattttctcctgacagcatcgtccattatatttccgttgattacattcccttatgtatcgagggttctgcaggcggcgggaaatggaaaagtagcgtttgccacagcggttctaacctattttacaatgtttgcatctctcggcattccaacctatggaatccgcgtatgtgcccaggtaagagatgacagggaaaagctttccaggacagtccaggaactgttgatcatcaatacgattactatggtgatcgtatatgcagtatttgcagttatggtatttctcgtccctgaatttgcgaaagagaaggaattgctgtttattaacagtatcacgatggtgctgaatgtgttcggtgtcagctggttctacagcgctttggaacagtatgcatatattaccgcatgttccctgacatttaaagttatatccattgttatgatgtttgcgtgggtaaaaaatccgaaagattatattatatatggtgcaattactgtatttgcatctgccggttcctatgtgttgaactttataaatctgcataaatatgttacattaaagaagaaaggtccctataactttaaacggcacttaaagcctataggaatcttttttgccatgtctgcggctaccagtgtatataccaatctggatgttgttatgatccagtttataaaagacgagactgaggtgggatattataatgcagcagtcaaagtgaagactatattagtcagcctgataacttcactcggaacggttctgcttcccaggctgtctttttatgtgaaacagaaagagcaggacgccttccggaaaacaattgtaaaggcattcaattttgttttgatcctggcctcttccgttatgctttacttcatgatatttgcgcgggagaccattttgacattgtcgggaagcgaatatcttccgtctattctgccgatgatattattaatgccaacggttctttttatcggtctgtcaaatattacaggcatccagatccttacccccctgggaagagaaagggaagtgctgatttccattatctgcggggcggttgtggattttgtgctgaatctgatactgataggaagatacggagcttcgggagctgctttcgcaacgctgctggctgaactgatagttttggcggtgcaatgtgtttatctgaaagacatgctgagcaaagtagtcagagagatcagcctgggcaaaacagcggcggcactggctgctgcaggaattgtgggaggcgtgctcaagatgcagctggaactaccttcgtttataatgatctgcataactggcgttgctttttatggtgtgtttggtatggcgcttcttatattgaaagaaccatttgtcatggaaatgtgggaaatggtgaaaaatatgctttataaaggatacaaataggatgatgaataaaagtataaataggatacatgacaggataagccctgtctgggataaagtgaaaaaacataatcttttgacggcagtcatcataaatgccgtctttctggcactcgtacttgtattctgcgagattaaatacgagacctcggatgattatattatggctgcgatcatgtccggagcctacagcggtacaccaaatccgcatatgatatttattaatatcttatgggggtatcttttactgccattttattatctggttccgcagatcagttggtatctgatcgcgcagctggcattgtgtttctgtgcattcacggcggttacttatctgttgctgaagaggctggatacgattatgggtatcatgctttccgttttatttattacttttttttcagatgatgcatatattatggtccagtttacaaaaacagcgatacttgcagtaatggcgggaagtatcctgtttttgtgggcattgtttcatgacgaaaggtgcaggaaacgggagattgctgcaggagcggcgcttgtagttgcggggagcttgataaggtttagtgtgatttatatagccggtgggtttttactatttatattgattgtagaatttatacaattttttcgccataaaagtgaaggaaaatggaggaagtttgtgcaaattgctgtttctggtgttatacttataacggcagtagtcgtggcaaaacaattagacagttatatatacagtagaaatgaaaaatatagtttttttaatgaatatagtagtgcacgggcaggaatagtagacaaaaaggattacggatattgggcaggggaaaaggagtataagaaattaggactgtctgaaaatgattatttattgctacgaacttggaatgccgctgatccagacttttataatttagatttgcttcagcagacaaaaaaaataattaatgattatgaagagacattgggacttgacagggattatattaaagcggagctgagggcaagaaattattggtcatacccggctttatggggggggtttattttaacttttctaaccatttgttttattaagcgatactggggaatagcagtaatatctgcaggaataacgtatttatatatggtttattttgtggtcattggacggatcatatatcgaatagaatacgcagtatttataagttttttcttgactataatttattgttgggataaaaaaagatgtcgaactatgcaaaatagtttggaaatcaaaaacatttgtggtatattattaatattactgtgtacttatcagttacccacttatcgtctaaataattgggctcaatttatttcaggggatgagtataaaagttatattgaagataatttctatgagtcgtggaattatgatagtaggagataccgttgtgctacgtataacgaaaatagctttagtaatcttaaaactaaaattatttcaaatccgcaagattattattttttaaactttagtactacaattcaggtattataccttgctgataacccgttttttactaatggtgaagaagaaacatatcaaaactgttctttcttatatggggttacagttaattttcctgatatactagacaaattagaagtaaatggagtggacaatcctttaagagatttagttaatgagaatatttatttagtagataatctctatcaagagaagattttaaaatatttacgtgagcattactatcctgatgctaggatggaacttgctgaagagattgatggatttaagatatggaagttttataaatattaaaaaggaacaaaagagggaaaaacatgattaattttaatgtaccaccagttattggaaaagagttagaatatattaaagttgctattgaaaatagaaagatatgtggcgacggggagtttactaaaaagtgttcttcttggatagaacaaaacacaggaacagctaaagctttattaactacttcatgtacacacgcaactgaaatgtcagcaatattagcaaatataaaagaaggtgacgaggtaataatgccttcatatactttcgtttctacagcagatgcttttgttcttcggggcgcgcgagttgtttttgttgatattagaccagatacaatgaatattgacgaaacgttaattgaaaatgcgatcacagatcggacgaaagctattgtgcccgttcactatgccggagtcgcttgtgaaatggatacaatatgcagcttggcagataaatatggcctatttgtaatcgaagatgctgcacaagctgttatgtcaagttataaggggattccattagggagtattggggattttgggtgttttagttttcatgaaacaaagaattttagtatgggtgaaggtggcgctcttttgattaaaagaggagaggatattgaaaaagcagagattgttcgtgaaaaaggaacaaacagaagtaaattttttagaggccaaatagataagtatacttgggtagatgctggatcgtcatatttaccaagtgaattaaatgcagcatatctatgggcgcaattcgaagaagcagataaaatctttaatagcaggatgagcaactggaatatttactatgataggttaaagcatttggaagataaaggagtactagaattacctcaaatacctaaagaatgtaaacataatgcacatatgttttatattaaagttcaggatctaagtgaacgaacagaactaattaattatttgaaagagaaaaatatcaatgctgtttttcattacataccattgcatagttctccggctggtttgaagtttggaaaatttattggagaggataaatataccacaactgagagtgaaagacttttacgtttgccattatattatggattgaaaaaaaatgaggttcagtatattactgaaattatagaaggatattattctagataaatgattggaggaaaagaatgattaaacgagttggtattgtcggagcgggagcagtcggtagttctttaggaagtgcactatacttaaaatacggaaatgatttttgctttgttgcaaggggagcaagagcagaaaggttaagaaatacaggcattacagttaatggagaaaagttacggccggacatatattccgcaccagatggaagaaagttagatttaattctgttatgtgttaaaaattatagtttagaggaaaccattgaagacataagagaacttatagatgaagacacagtaatattaccattgcttaatggagttactgctgttggaagggtaagagaagcctttccaaagaattctgttccttatggtattgtaatgagaacagatgcagaaagaatagataagaatataacagtttccgttagaggagaaatacaaataggatttggaaaaggcgaagccatttcagccgatttagacgaaataaggcggtgtttttgtgatgcgggaatttccacagttatttatcaagatatgcgatatatgttgtggcgtaaatggatgattaatatcggttcaaatcaagtttctgttctaacgggggccaaatttaaatattttggagaatttgaagaaataattattttagttactgatgcaatacaagaaattttagatatttctaaaaaaatggaaataggattaacagagaaagatcgggatgatatagttcaaatattaatcaattatccgcccgagaaaaagacctcaatgttgcaagacattgaggctaaaaggaaaacggaaattgactattttgctggtacagtcatcgaattaggaaaaaagactggaattgctacgccggttaacagaatattatactatgctatcaaggcgaaagagaaagttggacttgctgaaaaactaggagaagagcgtttataatacaccttttaaaaacaaactataagtatatgtgaaattaaaatttaaattacatgaatgatgaggtataaacatggaattacagggtaaaaagttggtcgttttaggtgggggagcaatgatttgtgaacttgtagaaaatgcaaaaaatagaggggcttatgtaattgtagccgattattattcgaattcaccggctaaaaaagtagctgatcaagcttggctcatcagtacagcagatacagagcaattggcggtaaaatgtattgaaaatggtgttgatggtgttatagctgcatttgatgactttaatgtagcctgtgcacaaaagctgagtgaaaaaataaagaaacctttttacgcgacagcagcacaggttgaagccactatggataaagtgaattttaaaaagttatgtaaattgaatgatgttccatcaactcctgaatttgaaatagatgatgaactatctcagaattgtttagataagataaattatccagttattataaagcctgttgatggcagtggggctagaggtattacaatctgctattctgagaaagagctgattgacgcttataagaaagctaaatctacatcaaagaaaggaaacgtaattttagaaaaatatattgtaggtgatgaaataggagtaaattacgtgctacaggatggggaaatttctgcaactgttttgcatgatcgatatatgcagaaaagtaatgggaatagtgtgcgtttacctgtggcatacgtatatccatctaagtatacagaaaaatacttagaaaatgaaaaccaaaaagttatagctatgtttaagtctattggtatggaaaatggaacactctttcttcagggatgcatggaaaatgaagtatgttatttttatgaaatgggatatagattaaacggcgcaaaacaatatcaaattttaaatgatttatgtggttttaatcctatggagatgattgtaaacttttctctaactggaaaaatggaagagcacagtataaaaccattagttaatccgatgctttcaaaagtttgttgtactttatcaattctcgcaaaaccaggctatatcagtaaaattacaggattagatagaataaaagcattaaaggaaacattagcagttacacaatggtacaaagaaggagaaagtatagatgaagatgctttagggacacaaaagcaaatagccatgcgtattacagttgcaacagaagatagaaagcagcttgctagagtgattaaccaaatctatgaaattttagatatactggacgataaacaaaatagcattttaatagatcaatttgatactacagagcttttaacagattagaggagtttgtagaatggatgtttatgaaatggggggatatcttccattagaattaggtgccgggactggtttttttaaaaatatagaagatactcacattttggaattaaatacgggtagagcggctatttggtgtgctgttatgagtctagatgtggataaagtgatggttccttatttttattgtcccgatataattaaaatgttacaaaatatggatgttgaaattattttttaccatattggggaagacttaatgccagttaatataaatatggatgagtctaattttgttattattctagtaaactattatggcattatcggcaatgaagtagtgaattattccaaaaaatttaaaaaggttattatagaccaggctcatgcattttattatcctccggttatgaatgacggggttatgaatgtttattcatgcagaaaattttttggggtacctgatggtgcttatttaattggaaaaggtataaaagacttttcactggaaagagatgtttcatataacagagcagtatttttgttgaaaagtattgaattagggaccaatagcgcatatttggaaagtaaattaaatgagactgaaattggaaaaaatatcttaaaaatgtctttgttaacaaaacatatactaaacggaattaattatgaattaatatctgaaaaaagaaaaagaaattttgaatatttgcataataggttcgataacattcaattattgaaaataccaaatggagataaggttccttatgtttatccgttaatgcttaatcaagggatacatgaaacattggtacagcataatgtatatgtgccaattttatggaaagatcttataaataataatgataaaaatacagtggaatatatgtacgcgagtaggatcatggcactaccaatagatcaacgctatgatattccagatttagagtacttgatatcattagtactagatatatcaaaaaataacaactaataaggaatatgaaatgcgtcgaaacaaaagtaagaaaaaattcaatataaataaagtttatgccaatgatataggacgttttggattatcgttttttataacgctggcaataatagttgttgtatttttatttgttcaaccagtatttatgactatagatgatgctagattattatatgtttatgcaggctatgcaacaggggttccagaggctaattatttattcagttattatcctttaggttggctcctttcaaatttatactcagcttttccacaaatatcatggtatgcaatatatcattttacattgatttgtttatctagttgtcttatcggtaagacaatatataaaataggtttacaaaaaaatataaagattgtttatttagtaatgatacatgtgatcttatacttatctttctatcttatttcaacaatactaatgcattttgaggttacggcaacaattataggaacagctggtgtaatactcttattaggaattgattttaagaacagtaaaaaagggataataatattcgaattgctaatttcagtcttttgtatctctctgtgttatatacaacaatttaatgcattttatgctatttgctgttatttattggttgcaatagtatatattttcttacatgcatttattgaaaagaacttatctagagttttaaaatatagtattgtgtatctcttttttttaagcctgatattattatttgtaaaaggaattgaggataaatcgaaaagttctgttgaatggcaagaatactataaatataataagtatagagtgagtttttgggattatgagcatgaaacatatgaagataatccggaattatttgataaaataggttggagtgaagaattttaccagttatcagaaaacatgtattttatggacaagcggtttaataaggaaaatttgggtgaaatagttgaaaaattttcctggttcgaactagacgagtgggataaattattacaaacttggaaaacaactcttaaagaactactaactggagaaaagttaacactattacacatatatattgtagtgcttctttttattgtctttataaaaatgggtataatgagaacatatagaaagttatattatccccaaataattgctgctttatgttgtattctaggcactatgttagttatttcatatcttgcagcgcgtggacgcctacctctgcgggcatggctggcaagtttaataccatgtggtactattgtatttgttctttttttaatgacttatgataaagcaaagctttcagaaaagaaaattcaaaaattatgcacagcattattattattatttccttgggcgggaatattagcaaacgcatatacgaagatttacactgttgactggcaatatcggcagagttctatcaatattgttggtcaaatagaaaattatgcactcgaacattcagatcatgtttatgtatttgatcaatttggtgcacagaattatggcgtctttaccaattatcctgaccctaaaaaaaggcctgtaaatttagtaccatggggttcaagttatgtgtttaccccaacttattataaacagcttgaatatttaggcaaggataaacttttgacagaaaatctttttgacgaagatgtttattatgtaacgtcatatgattcaaactataaggatttgctatcaaatatgctaaataaagaatatgatcatgtagagtttagagaggtaggagccattggggatgctgctataatttataaaatatcaaaagagtaatatgaggtgtgtgatggttattacaattataattccgtgttatcgttcagagaatacgttggagtttgtggtaaatgaaataaaagatgagattttaaaaaggagtggtaatgaatatcaaattatattgattaatgattgttcacccgataatacctttggtgttattacaaaattagctcaggctgataaaaatattattggcgttgatctggcaagaaattatggtcaaaatattgcacgaatggcggctgtttcttatataaaaggtgatgtggctgtatgtatggatgatgatggacaacatcctgcggatcaaatatataaactggttgataaaatcagtgaagggtatgatctagtatatgcaaaatttgcaacccaaaagcaaaaattttacagacgctttactagtcgaataaatactaaattgcttgaatttactggaagtaaaatgaaaggtatttataattctccttttttggcctggagcaaatttgctattgaaaatttgaaagcatacaaaagtccatttccgtcagctggtgcgtatttaatgagaacaacgaatagagttacgaatgttgaggtcgaacaaagaaaaagaatatccggatcctcaggttatacattaaaaaagttagttaatctctggcttaccgaatttacgaatttttctttagtgccattaagacttgcatcgttattaggtgtattcacgtctggattaggtatatgttggggtatttttctagtaatcagaaaaataattaatccccatatagctatgggatatacgtcaacaatggctgtgttactttttattggtggaatcattatgttaatgctaggcttgattggagagtatatcggtaagatatacatgactatcagtgatttaccccaatatatggtaagagaggatttaaatgcagacgtttaaaagtgaggtgattactgatggataatgaaagaaaaacgttcgtacttcgggacacgcaaattcaaaaaggggtagcaatacttatactaatattgctacacctttttttccgtggtgaagcagcgtggcctttctttgattattcttggacaatagaaaataagccgtggattactacactgttaaagaatggtaagatatgtgttgacatttttgttatttatagcggatatggtctaaatgagagttttaataagaagatacagggaaaacagaagagcatcaggattagtataaaatttgtaactgcgcatttagttaaactttatacaaatttttgggtaatcttctggatctatttaagtgcaggtatgatatttgaaaaatttaatatatttactatttatggtgagggtaaaaatggtgtcttagcatagctgattgatatgttaggattaagagatatattatttgaatggtgtcatacaggaacaataaatgttacatggtggtttatgtcagcaattataatactttatctaatatttcctataataaaaagcatgatgtcaaaaatgcgttatttaccactattgctatttttatttattaatgttagtgcttgttatactacatataggcaaatgagtacaggggtatttttttacttatcggcatttgccttaggaatgttgtgttctgagttaaaaataatggataaattaattaatctcgatctaagatataaagataaattaatttatagtttaatcttattttttgttacctatatttggggatttcatgataggtttagcggagaattgccacatgctttttcagtgattttattagttaatgttctagttatcgagagaaatgctattttaaaaaaagcaagtggtgttttagtatttttgggaaaacattccactaatatttttatgttccatactttcatactgctctattttgaaaaacaggtgtattattttagaaatccatttcttatttatataaactttataataatagtaatagtgatttctattatattagaatttataaagaaatatagtggtttttataaattgcaagaaaggttaattagcttaatctggcaagaaaaaggttcaagataagttttatagcaatttattttttagactgttaatagtataaggagatagctatgattacaaataacaggatagtaataatcggagcgaatgaatttcaaaatcaattaattgtaaaggcaaaggagatgggtcttgagacgcatgtttttgcatggaaatgtggtgatgtcggcgagaaaactgctgatttcttttatccaatcagtatcacagagaaagaaaaaattttaaaagtatgtaaaaagataaagccaattgctgttacttcaatagcatcagatttagctgtagtgactataaattttgttgcagaaaaactgggattggtttgtaacggaattaaaacaacaaaatatacaacaaataaattcgagatgaggaagaggcttgccgaatcttctttgccagtaccccaatttgcatgtgtaaacaaaacttggagttgtgaagaaataggtgatttagaatatcctttgatagtaaagccaactgatcgatctggaagtcgtggtgtaacaaaagttttttctaaaaatgatcttaataatgcaattaattatgcgtacaaatattcttttggaggacaggttataatcgaagaatttatatcaggtgaagagtatagctgtgaaactatttcttacaatggtgaacataaattattagcgataactaaaaagtatactacgggtgccccacactttatagaaacaggacatctcgaaccggcgcagattgatgatcatctatttgaaaaaattgagtctcttttagaaaaggcattagacgcattatcaattacctcaggtgcttcacattcagaaattaaaatagatgaggatggaaatatagggattattgaaataggtgccaggatgggaggcgattgtataggttcagacttagtgtacctgtcaagcggatatgattttttaaagatgacaatacaaacagcatgtggaaagcaacctgatttagaaagaaaacatgcgccgcggtatgcgggaattcgattcttgttgaataaaaacgatttagcccaattaagaaaaattgagaaggaaaatccagaactgatttatagaacttggatagatagtgaagacgaacgaatagtagaagacagttctacaagattggggtattttattatatcagggaatgaaatcaatgcaattaaatgcctgtttgaatgaaacgtaagagtttactactataattgatgccatttctcttatatattaagagtattctgaagttttgtcatggcttatgaaatacaaggagaaaaagtatgtttaaaaggatagatacattaaaggtaaaaggtatagcgatctctttattattattccatcatttattttactcaacggctcggattgaagcaaatggggtggtttttcatatattttcgcaagacacagtggaaggactggctacggcatcacgaatatgtgtatggatttttgcttttttatcagcctatggtttaacttgtaaatatataaaagaagacattaaaagaccgacaatatttattgctaaaagttggatttccctaatgaagtcatactggtttatttatataattgtttttattttatcatttatattttttaataatccacttgaaatatatcaacataaggcctcttatttagtattagacgcgttgggactggcagacttttttggatcaccaatgttatctaatgtatggtggtatatgtgttttgcacagattcttttgataattttgccgctgattatagcagtttgcagtaaatttggatgggcaagctatttactaatgataattattattcagtatttggggagcggcatatcttcaaattttggaggagaatacataaattatttatttagttattgttttgggtgtgctatgtgctcaaaatagtttttttgacaaagtgaagagcaagccaaaacatttaataggaaaaattattgaaatatgtattttagttggagtaatttttatatgcttaattctacgccttaaactggaagaggttgatgtttggaaggttagaagtatactaagcagcctagctgttttatgtatatgctggatgtcatataagtatttaactaataaaatagtagaaaaggttttatcatttttaggtaaacactctggaaatatttttatgactcatgctctgatatatactttttatccaaatgtggtgtattatactaaaaatgtaattttaagttggttaacactgttatccattagcttgtgtttatctatagtattagaaaaattaaaagagttaacgaaatataattgtttgataaaaaatatagagaatatgatatttccagaataattcagtaccttattaaggtataatataacaaaaccatttgtatagtatatttggagagcaaaagatgaaattaaagcattttatactgaatgatgaaaatatagagaagagtagctacatatggaatatggccgggagtatgcttatggcatttcaatcggtaattatgctcatgatattgactagaacagtagggttaggagaagctggtgtttttactatagcttatgccaatgcaagcttgtttttaaatattggcaaatatggtatgcgaaattttcaagtatctgatgtatatggacagttttcatttattgagtatctacgctccagatggatcactactctcttaatgatcattgtagccacttcctatatagtgcatagctctttggttaataactatagctttgagaaaagtatggtgattatatggatgtgcttgtttaaggttgctgatgcaatagaagatgtttattatggcatgtatcagcagaaaggaagacttgatatagctgccaaagctatgacgttacgcatgttctttacgatcattatatttggtattggtattattgtattacgtagtcaattagtatctttgatgatagctactatgactacttttggttttttagggcttttcctctcatggacttatggcacatttaatgtaaaaaagggatattgcagaaaaggacaagtagcccggctattaaaaagttgtttcccattatttgcaggtgcatttttatcattttatataggaaatgctcctaaatatgctatagatgccttgctatcagatgaactgcaggcctgctatggattcatagcaatgccagtatttgttataggtttgctaaacagttttatttttaaccctatactttttcagatgtcttgcctttggaacgaaggtaaagtaaaaaggttcataaagagaacgattgttcagataggcgttgtagtggggataactatcatttgtataattggcgcttattttttagggactccagtactttcagttttatataatacaaatttagcaccatacaaaaaggaacttctgattttattggttgggggaggcttcttaggactaacaggattgttaagtacagtaattacaataatacgttttcaaaaggggattgcctggggatatgctggtgttgctgttttggcatatgtattctcaaatccagttattagcaagtatggaataatgggggctgtggtattatatgtaatgcttatggtaattttgtgtctatgctttgctggactatttatttcgggggtttatattcaaaataaaaaaagaaaattaaattaggtttattacttaaatattgaggatggaaataaaacataagcgaagctttattggacagaaaaataaatttatggtaaaacaagttacttgatcttgggaagcgcaataagatgattttatttatataatctaggcgggctactctcaaatatcctagagcctgagttttatattattttgccgtttaagtgtgctttaagtattgtaataatatactacaactctaagtaacgccgtattccaattctataaaatgcagacgaagccattcgcatcgtaataatcagaaacagattataaaacaggtctattactatatagttacattaatgtacagagggacatttcttcaattctaaaagctgtacacagttcttatttttaaggcttttacagtattcgctgggctttaaattagtataccgtttaaactgattagaaaaataattcacattacaaaaatttaaaaagtctgatacctgggttatattataagcgcctaagcacagcagttcttttgccttatctattttaagctgcgtataataattcatgacggttgaggcggtatactttttaaatacagcagacaaagttgacttcgaacagtgcagtttttgacagagagacgagagcgtaagggaagaaaaaagacattgtctcattatcataattgcttcgccaaccaaaggcggatattcatcttctggcacatgacgttccggatatgtaagagtatccatagatatcagcaactccagcaaaaaggattctaaattattaagcagcagctgttcttgcgccgggctgtggtcaggtgaaattatctggtagatcagttcttttgtgtcaataacagaggaaaagatctcactgcagtatttcagtgcattaaaaaaataatgtttcatagaagttgtcagaagaatcggttgatcagctattttatcgaggacattaccctcgtaataaaaggctccgttgcatatggaagtttttatgttctttatcgatctatgccggtgatattcattaggcgcatggaaataaatatggccttcttcaagtataacagtcttagacccggtaatgatttccacacttccaatatctgcataaataaattcccagtagttatgagtttccccgatagatgtaaatttaggattaagatcgcagtaaaagaaactaacgatattatctaattgaattgttttattaagaaaagtctgctgaaatgatttttgcatatctattttcactctttccgtttgtaaggctcaaaatcttattgtttcaaccgaaacactttaccttcctataaaatataacacaaaatggattttcttacaaatatcatgtaagaaagtgtatgtttttattgcggaatatcaggtattatctaataaattatactatgtaaagttattgaacaggagggtatcaaatgaatggcagagaaagaaccttaaaatttttgaatggtgaaaaagtggattatattccattccatccattggtcatgcagtttgcatctgaatatgcaaagattccgtttagagagtattgcctggactataggagccaatgtaatgcaatgataaagtttgcagaagactttggcgtggactggttccatccgtcgggatttgcatattgtgaagcgggtgcatatgggatggatatcgtgtatcctgaagatgactgcccatatccaaaaaagcatttaatccttgattttgaaagggattataagaagataagggcgctgaatataaaagacaacgatgcgatgatgaatcgcgtgagaggagttaagcattataaagatacggtcggcgatgcgtattttatagcaggacacgtagaaggccctttggcggaatatacggatttaagaggcgtatctgaaggactcatagatttactggattatgaggatgaactgtcagagatatttcagattatagtggataattcgaaacgatggattgatttacaggcagaagcaggggcagactgcattagtataggcgatgctatttgttctcaaattagcgagtcaatgtatttagaacgtatttttccatatcatgtagaaatgattgaacatgcaaacaagttggggatatatactaaattccatatctgcggcgattcatccaggatcctgccgcatttaatagatgccggagccaatatcctggatatcgattcattagtgaaagatgtgccttccctgataaaacgactgggtaaggggcaggttctatgcggcaacctggatccggccgcggtcttgagatttggcacaacgcaaaagattgatgatgaagttaaaaaaataattgatgatacaaaaggaaaatgcatgattggaggcggctgcgagataccgaaggggacgccggctgaaaatatgcataagtttttagaagcggttaaaaaatactcttattagataaaatatagaattgaataaaagttattaaaaaggaatttgctgtctgtataagaaagaactattggtttgaagtggattctatgatataatctcctagtggataaactttaagaaacaagaaaatctaaaaggagacaaggcccatgaatatacagatctttggaacaaaaaagagctttgacagcaagaaagcagagcgttatttcaaggagcggggcataaaatatcagtttatagacatgaaagaaaagggactcagcaaaggagagttctactccgtctgccaatcaattggcggctatgaacagttgctcgatccgaattgcagggacaaagatttacttgccctggtcacatatattgcagaagaagaccgggcagaaaaaattcttgaaaaccagcaagtgataaggacaccgattgttagaaacggaaaacaggcaacagtcggctatcagccggacatatggaaaatttggaaataataggaggactaatattatgagaaaaaactttggagcaaagccatacacatacccacagcctgtattgatgattgcaacctatggcgaagataatatgccagatgtaatgaacgcggcctggggcggcatcagcgacaacaatgagatttccatgtgcatcagtgaagggcataagacaaccgagaatattttaaaaagaaaagcctttacgatcagcatggcagacgaggcacatatggcagcatgtgattacgtgggcatcgtttccgctaataaagtgccggacaaatttgcaaaagcaggatttactgcagagcactcagacctggtggacgcaccgatcatcaaagaacttgccatctgcgtggaatgtaagctgaaaagttatgaccctaagacttgccgccttgtgggagagatagtgaatgtcagtgtagatgaatccgttctggatgacaagggaaatgtagacgtagcaaaagcagcgccgattacttttgatccatttaataatgcttatatcaaactgggcgaaaaagtgggaaatgcatttaaggatggagcaattttgaaatagacagaaagaagcatatacatatgggtgacctgtcaggaggagaaatcggggtgttctggccttaccgtttttggtgttgaatatacccagaagaagcgttatgattaaaaaacaggatgactaaacgaagtaaggaagtatttgattatgccaaaagaaaagatatcgctgattgtcccctgctacaatgaagaggaggttctcccttatttttacgaggagttcaaaaagacagcagggcaattagcagaatatgaattagagctcctttttatagatgacggctcgaaggacagcacattagatcttgcaaaagatatggccaaaagtgataacagggtcaaatatctttctttctcccgcaattttggcaaggaagctgccatctatgcgggacttaagaatacggacggtgattatgtggttctgatggatgcggatctgcaggatcctccgtccctgctgcctgagatgttaaaggcagtgaaagaagaaggatacgattccgctgctaccagaagagtgaccaggaaaggtgaaccgcccgtccgttctttctttgcgcgccggttttaccatctgatgaataagatttcttcagctgagattatggatggagcgagggactaccgtttgatgaaccggaagttcaaaaatgcaatcctggaaatgagtgaatacaatcgtttttcgaaaggtattttcggctgggtaggttttcggacaaagtggattgagttcgagaatgtagaacgtattgcaggtgagacaaaatggtccttttttaaactgttccgctacagtcttgagggaattatcggtttctcaacggcacctcttgccatggcatccatattggggatgacagtttgtgcggccgcatttatatttttaattattatcctggttaagactttatgttttggagacccggttgcaggctggccttctatgacctgtattatcctgatgctgggcgggattcagctgctttgtatagggattttaggcatgtatctctccaagacgtatctggaaaccaagaaaaggcctgtctatatctgcgatgaaagtaatttggaagaagaggatgaggagaaaaaggaatgaaccgggcaaagaactttatgagagggaattcggatatactttcgcttatcctgtctattacaatagcaaatctgttgttttttcatcaggaaaagtggctgatgaatccggtttatattgcaggattatcgattctgatttatgcggggcttaaagcggcccgaaagaatgcgtatctgctgaagcacggccgcatattgccgggaaccgtactactgggtatcttgttttctctgatgattgttgttggacagaagatacatgcggacagcgtatcttttttagtttttacgggatttgatattatctggtttattctttatttttttgttggatggcttctgttttttgatttatatctggctggtgtgaatacggcggtaagaggccgcatgacttcaggagaactgccggttccgaaatggaatcaaagaaaatggctgctctacagcgttattttgtttgcagcctgggttcccacatttgtaacttatttcccggggattgtacctgatgatgctacggtttccatggcaattgctttcggggagatgccatgggacaaccattttcctgttttttataccttaatggttggcggattcatgctcgtgggctatatcttccataactttaatattgggattgcgctttattctgtatttcagatgcttattatggcaggaattctggggtatttgctggagtggattgagcggaaagggtttaagaagattctgatctatctggggctcgcatattttgcggcggctccggtttttggaaactatgcggttgttatgtggaaagaccccattttcagcggtgttcttattcttttagcactgatattaatcgatcatgtcgcagtgaatccggattcatttttagaaaagaaagttttgatcagctatgcagggctgatgattctggcctctcttttgagaaataacggaatctatatcgggatcttgctcagtgcgggacttttgatcgtttacaggaagcggttaaagcgggttttgataacatcggtggtcagtattggcttgatctggtttattacggggcctgtatatgtgcacatgttttctgccgaaaatgtttttgtggaatcagtcggcatccctttgcagcaaatggccagagtcgttgtcacagagggagagatgagcgcggaagaggaagaatttatggatcatctgctgccattggaaaagtatcaggattattattggccgtttttagtggatccgatcaaatgggcgcccgaattcgatacggaatatttagacagccacaaaaaagaattttttcatgtctggttttccatgctgactaaaaattttgatgtctatgtaaagcagtatcttatgggaacgtatggcttctggcatataggcggggagacgaaatacgagtttgtgaaaacggatattgccaggaactggtgggacatgtatcagaatcagccttttgaaaatgtgctgggatatcctatgcaggaaaaaatagtggaaaagtacgattatatatcaacggggctgttggtatggatccttttatttgatattgttttctgctggatgcgtaaaaaatcagtgtatatcattcctctgctggtcatggcgggcaactggctgactttgatggtggctactccaacggcatttggcgtcaggtatatctatctcctggtaatcggcctgcctctggtgctgctttatccgtggctgctgaacagagatccgcaggggaaaggcgctgctgttcacagataagcatgtaaacagtaacttccaaaagcaagggcatttgtgatatagggttgtacttttgtatgaatttggtaaaataagaagcaggaaacttcagactggaaggagaggtcaaatgaaaaggctaaaaaaggtaagtattgttttgctggtatttctcatgatatttggcgcggccggctgtaagaagaaggaagcgcccaaaagagcagagaagacagaagaaaaagtagtaaaagagaaaaaagaagagccaaagcaggaaaaggtgcctgcaaaccagaacctgctgacagggctggcggatctgacagacggcgccataggcaaaaggcctgtggctgttatggtgaataatgtggaggcggcgctcccacagcttggaatttcaaaggcagacattatctacgaaattccggtcgagggagatgtgacgcgccttatggctttatacgcagattacactgcagtacctaagatttgtgccgtgcgcagctgtcgttattattttccggcatattcacagggatatgatgccttttatgtgaattggggaattgatgacagtattgcagactatctcgaagcgctgaacctggaccaatatgacgggatgaacaatgcaggggggctgtttgggcgtgaccaggacaggctgaatgcaggatattcattggagcatacaggatattttgatgggaccagattcgcagaggtggtacaggcagaaggcaggagaactgatttaaacgaggataaaaaggggacggcattccagtttaacgggatggacgaacagctgaagccggaaggacaggactgcaaaaatgtcaacattaattttggggctgccacggcaaccctgacttatgacgagggctcaaagacttacttaaagcagattaacggaaaaccgcagatggacggcagtgacaatacccagctcgcttttacaaatgtatttgttttggagacggatatttctgtaagggatgatattgggcataaagaaatcaactggtatggcggttctgattacgtaggatattatgtgtcaaacggcggcatgcagaagatacattggagcaaagaagcgaataatgagaattcgtacctgcgtttttacgatgagagcggcaaggagatcaaagtaaatcgtgggaagagctatatcgccgtaaactataagggacagagtgagttccagtagagccgggaattgaggctagttataatgctgaatatcaatgtgtcagacacgctctagggcaataagcagaaagcttcggttatttgatttctacagtttatgaagtaaagggaagcggatggagagttaagcaatgtcgggaaaatttagatcagatgatacaagaaaacgaaatttgctggcgctggggattgttttcctcagctccatctttttgtttatcctaatacaggccgggagtggattatatcccttcggcagcaagtctaatatgctgtgggaccaggatattcagtatgtagattattttgcgtattaccggaatgtactgttgggaaaagcagacatcgggtattcgttcacaaaatctctgggaggttccctggttgcattgttcggctattatcttggctgtccgctgaatctgcttgttgtgttttttcagatagagcagctgcctttgttcctgtttattcttacggcagtaaaacaagggcttgcgggggtgactgcaggaatctttttctggaagcgttttccggcggtatcattaagaatgcggacccttatttcgctctcgtatgctctgatgcagtacaatatgctgcagtcatctaatattatgtggctggatggcgtaatccttctgccgcttttactgctggctgtttacaggtttgtttccgggaaccggaagcggtggctttttcttaccgttctattttccattgcaattaactggtatacaggctatatgacaggtttgttcgccgtatgttatttcctgtacgaaagaatcttaaaaattgacaagccggatccaaaggagcgaaaaagattcataaaagataccatattgtgtggcggcatcatgcttgcaggggtgctcggaagttgttttattttttatccggtggtggtgggactgcagaaaggcaaggatgcttttgttcctgagatcttccatttggccacacatggctccctctttgatgctttcaaaggctttgcactgggcagctattttgaatcagtatcgttatactgcggtctgctcttttttggattctttctttattattttttctcacgccatgtggaaaaaaaggagaagatattatccgtaattgcggtaatgtttatgctggtaagctgctggtttgtaccgctggactgcgtctggagcggattgaggtacgtggcaagctatccatttcgatttgccttcattgtcatttttcttgttctgtatctggcggcaagaggggtgcaggagtatgaaaagataaaagacggtaaaaagatggcggcggtatatgcgggatgcatcctgctgttcctggtgtaccatttggctggcggatatggaaagaatcaactgcttttgactgtagcggttcttgcagtgtatgctctgctgtatctgttttcaggaatgggggaacgaaagcgggcagggctgcagaatatggttccagctgtgctggccgtggaactggttttaaatgggatcatgacgtttcagatgaattacgagtggaatcaggatatttccgcttaccaggaatatacggcccggaatgcagaacaggttgcagcggtgaaaaaactggaatcggacgagttctacaggatggacaccctgaataaaaggtatgacgaggagagcagatgctcggcctttttaaatgaggccatggtttatgactaccgcggcctgaatcattattcctccacatttgatggaacgacaggggattttctacgggatattgggtattcttctgagagtaccataagcatcgtatccgaatcaagcctgccggcagattcgctgctggggataaagtatctgttgtctgcatcagaggtggcaggctatgaaaaattggattccataccggaagcaaacggaaaatccgtgtactataacccatatgcgctggacgcaggcatggaggcggcggatactgtttatgaaaaaacggagagtgccaacccctttgaatatcaaaatatgttgttttccaaaatccttggaagagatgtagaactttataaaaaagcagagccggaggtacttattgaagaccaggtgctgaagttcagtatacctgcgtcgggaaaggacgatctgctctatggatatgtagactcctgggtacatgaccttgtattatatgtagatggcgggtaccgctgtaattatgccacatggctgagctataagatttttaatgccggagacgggacgaaggcgcatacagcggcactggacgggtacagtggaaaagaacaggatatgacgccatatttctattatctggaccaggatttgttcgaggaagctattcaggaactgaaggacaaagagatggtaacagaaaaatttgaagacggatatgtgaaaggcagctataccgcagacgaagactgcaatatgctcctgagtatcccctatgatgacggctggacagcctccgtgaatgggaagaaagtggaaatcaggccggcagccaatgcgctgatggcagttccgctttctgcaggggagaatgtaatcgaattgaagtatgagattccgggggtgaaagcgggaatcggcctatccattatggggttgttcatatttttcgggatatgctggatggacagaacgaaaaagccgcatgcatggtacaagaattgagagaggaatatttgaattgtacagcaccgatcgtatacttaaatttccggcagcactgctccacaaacttcagcgtataccactacgcctgcgtttggggagcagtaccctcgaaaattaatctctgcttaagtggcagtgctatcgtaaattcaggccggcttatatggcagttaattatgatacgatgtaccagtctgaactactcgtttccgagaatctcttttgcaagtcttgcagctaaaacattcatctcttccatctgtgaatcctttagtgatgatttcattgcaaagttttccgtcaggatcgtcatattcttcatctcaccgatcttcgcttccatgagtttagcagacatcggagcccaggttccgttgccaagcacagcgaccgtacggttctgcacattcagcgccttcatgtcatccagataattggccatgacagggtataccccgccgttataagtaggggaggcaagcacaaggtggctgtatttgaagctgtcggatatcagctgggaaacatgggtgcgggaaatgtcatggacaaccatgttcttcacgcccgcgtcggcaagcttgacagccagtacattggcagcattttccgtattgccgtacatggaagcataggcgatcataacgccacggacttccggctcatatgtgctccagatattatattttccaatgatataatccagattgcttctccagacaggtccatggagtgagcagatataccggatgtccagcgcagcggcttttttcagtacattctggacctgaacgccgtacttgcccacgatgttggtataatacctgcgggcatcatccagccagtctctgtcgaagtcgatttcatcattgaaaatcgtgcctccaagagcgccgaaggttccgaaggcatctgcagagaacagaaccttgtcggcctcgtcataagtcatcattgcctccggccagtgtaccattggagccatcacaaaatgaagggtgtgtgtaccactggaaaaggtatccccttctttgatgatgattttcctgccttctaagtccatatcataaaactggccgatcatggggaatgttttggcattaccgataatctgcattttaggatagcgcagcgccagttctgcgataagggaacagtgatccggttccatgtgattcacaaccagatagtccagggttcttccgtcgagaactgcttctacattttccagaaactgccttccgatagaagcgtctacggtgtcaaagagaacggtcttctcgtccatcagcaggtaagagttataggaaacaccgttcgggatggggaaaatgttttcaaacagctccaggcggcggtcgcttccgcctacccagtataagtcatcggttacttttctaaaacagtacatatgtgatcctcctttttatattcccccaggcagtgaaccgggcagatgtgcaggtatggccgtccggctgcagataccggggaagtttgtcctcagttcgttatgtgtttttaatagaaatagattcactgaatatgtggcagaaaattgtcttccgtcactattctaccataaaaggaaaaatacgcaacccgggtatccacattttttagtttatgttacaatataaaatatttatttcccttataaattccttataattgtcttttagaatgtccttatagacaaggaggttttaaaatgaatgaaatgattttggaaacaaagggaatttgcaagaggtttggccgtcaggttgtgttgaaccaggtatctctgatggtgccaaaaggctgcgtatatgggcttctggggccaaacggcgccggtaagtccacattgatgaaaatgttttcgggcatgatgcgcccggatgaaggagagatcttttttaggggaaagccatggagccggaaggatctgaacagaacgggagcgctgattgagcagcccccgctgtatgacaatctgacggcacgggagaacctggaggtacgcacccttctgctggggcttccgaagaaaagaatagacgaggtcctggaaatcgttgatttaaaaaatacggggaagaagcgggcaggacagttttctatgggaatgaaacagcgtctggggattgcggcggcgcttcttaataaacccagccttctgattttggatgaaccagccaacgggctggatccgtttggcattcaggaactcagaaatatgatacgggatttttccgatgaaggaatcactgttatcgtttccagccacatattaagcgaggtcgagcaggtcgccgattatatcgggatcatatcggggggcgttctgggatatcagggcggcatgaagcagggaaaggacctggaaggcctgtttacggatgtggtcaaaaagaacagggggcttgaggcatgttgttagcatatgtgaaatcggagaatctaaagaacagacataccgtggcgtccaggcttttttggctggtacctctttttagcattttgttgtcatttgttttttcagggcaggacggcaggtattaccaaatgaatcagtataattggtggtatacaacgtttttccctatgctgctgcttcttagcacggcatttgcaggccagcgggaaaggaagatgaagaatagggctatgggtgcactgccgataaacatgaagactttatggagcgcgaagatcttatacagcctgaaaacgcttgtacttgccgttctgatcttattctgtgtacaggaagtggtcagccgtcttctggtttttggcggcgccagagagatctcagggctggccggccttgcggcagctgtcctatggattgtgcttagtttgtggcagatcccgctctggctgtttgtgaaccagtcgctgggatttgccgcaggaatacttctgggcctggcaggtaatatagggctgggaattctgggcgctctgacaaaatggtgggtggtgaatccatttacttatatcagccgcctgatgtgtccgattctgaaaatcctcccgaatgggctgccggcggaaccgggcagccagacctttttcccggaagtattaaagataacagtcatccctctgggagtctgcatttctgtggcgctgtttttgggagtctgggccttgacggccggctggtatgcaggaaaggggcgaaaaggatgggaaagctgaaacagaagaacagggggggtcagatgctgtgtgctgaattggtaaagctgcgaagaacatggatattgtggctccatgtcattatgccgctgacgggaatcgttatatttcttttttactaccgtatctcagggtggagcagctggggaaagatctcgggctatgtggaagtggtgtctgttgtatgcccgacacttgtagggtttatctgcggacttgcggcggaccaggaaaaacaggcagggcatcttcaaaatcttttagggacaggacagcgaaggacagcgaatctgtccgcgaaactttgtacattactgctctggaacctggcagcagtgctagtgacaattggcggttttggcgccggatattatttgtttattgaacggactgccgtaccggagatgttttatataacggtgacaggactgatctggatcagccagatattcacttactgccttcatttgtttttaggtctgcggttttcaaaaggcattagcatagggaccggaattgtggaaagcctgctggccgcgatactgatgaccgggcttggagatgggatctggcagtggatcccgtgtgcctgggcgggccgtttcacgggattgtatgtacagcgtgcagcaggtatggattccgcggcttgggcactggcagagtcccagatgaaaacaggaggaatcgtgatggcgggaatcaccattgcaggaatactgctgacatatctctggtttcactattacgaaggaaaacggatggaagattaggggtgtgttaagatatcttccatcctggagacaaaagcagccccatgtatcagcagttccagtttatttttacgggatccggttcatcgggaaccgcggctttctgcagggaggctagcattttagaaaattctttttctgccagctgatcataaacctccggggattccaaaagcccggccctgtggtagacgatcgcagcggctccgtagaatgtcataccaagcgcaccggtgggagtggagattacggaggcggccacggaaacagcgcgtgctgcggcctgggcttggggatagtcttctgcctctttcgcagcggccgcggcttcccgtatgatttttttggcatcggtcggttttaagactttattcagccagcccgctgaagcttccagggcggcgcggggacgccggtctgtgggaaatgtctcttcgtaaatgggaagaaaatattcctgggcatagcggatgcaccagttaacaagcgtcgtttttgattgagtttctatgacccgcatcagagcgttgataacgggatcatctgcatggcccagcatttttctaagtgtaggtttcgccattatatttggccctccttgggattgattgtagagagtataccatttccaggcgcaaaagacaatatttatgagcagttaagttatacctataggacaccccgtaattcatgccctgcgggcggttctgcagcaaagctgcagaacaaagtatgaaataatatggaaagtttttgtccgctgtccagactgtggagggcagagaaaatatttaaaaacatgagaaaggggatggagtggatggccaaaattcttgcggtagacgatgagccggcaatacggaatctaatacggagggctctggaaaaggaggggcactgtgtgacaaccttaaactgtgcggatgagattataatagaaaacctgaaccaatatgacctgcttttgctggatatcatgatgccgggaacggatggcatcacatttgtgaaaaagatccgcagccaggtcgacagcccgattcttttcctgacggcaaagacagacgaaaacagtattatgtacgggcttgcatcgggcggagacgattatataataaagccctttgggatcggggaactgcgggcacgggtacaggcccatctgcgcagagaaaagcgggagaagaggcatacggcggaggtgtcaggtgtgcgcttcgatctggcgggaaaaaccgccggagttggggaatgccgcgtgccccttacaaaaagcgaatatgagatcagtgagtttctggcaatgaaccatgggcagatgttttctaaggaacagatctatgagcgcatattcgggtatgacaaggatggggacgtatcagcaattacggagcatgtaaaaaacatccgcgctaaattttctcgggccggcagggagcccattgagacagtatgggggattggatataaatggaaatgaaacgcaaggtaacagtacagtctatatttcggaggtttttggtctggttctgtctgatgacagcaggccttttcttgatatgcgtaatcatgtttggcgttttaagtgcggcaggcgcagtactgccggctaattacagtgaagtggcgctggaaaggcggcgcacagagatacaggaagccgatattgtgacaaaagaaatgataccggacaattgtcattatggagtgtacagcgaagacggtacatttctgtacggaaacttgaggcagagttcacaggaaaaggtgtggaaagagtacaaaagaggcgggggcggtgacggcgccttagggtatctgaaatattttccacgggatggagaagtttgcctggcggtctatcaattaagagcggagttcacaaatccgttacttaaaaaaatactgccgggggtaccggagggcctatttcttttatttataatcctgtttttcatacagtccgttctgttgatccggcgtttcggcaatgtgatacgcagggaactggaagcggtcaagctggtgacggaaaaggtcaaacttcaaaacctggatttcgaaaagccggattccaggattgtcgagatagatgaagttatggagtctcttgtgaaaatgaaagaggccctggaggcatctcttaagcagcagtgggaaatggaagagaacagacgccagcagatccgcgcgctggcccacgacattaaaactccgctgaccgtcataaggggtaacacccagctgtcctgcgaagcggagtcgcttgaggagagcagggaatgccaggaatatattctgcaggagacggacagaatagagcagtatatctgcatcctgcaggaaatgctgaaatctgacggcgccgttaagctgttggaagaaaccgtggcaatccggggacttgccgaatcctttgctgaaaatgcaagagtcgtggcatctgcattcggacggaacttagaggttgtaatttctctgatttcagactatattattagtgacaggcagatgctcttgcgcgcctgggaaaatctgctggacaacgcagtggaatacacgcccaagggtggaaatatcaccatcaaactgtacgaagaagaggacaggctttgttttcggattgaggacagcggccctggttttacggaggaagatatccggcggggaccggaacagttttatcagggcgataaaagccggaattccaaaagccattacggcatgggactgttcatagtccagtccttcgcaaaacaacagggtggaaggctcacccttggcaacgcaggcacccataagggagcctgtgtctgcctggaaatcggcataaggcctgcttgtccggagatggatgataagaaaaatggaaagtgaggaaaacatatgctattcgtctgttaccccaaatgcacaacctgccagaaggccagaaagtggctggaagagcagggcatctcttacgaggaaagagatatcaaaacagaaaatccccaaaaagaggaactgaaggagtggtataaaaaaagtggtctgccgttgaaaaaattcttcaatacaagtgggatgctgtacaaacaaatgaacttgaaagataaacttccagatatgagcgaggaagaacagctcgaactgctcgcaaccgatgggatgcttgtgaaacgtcctatagtagtggatggggatatcgtactcaccggcttcaaggcggctgagtgggagaaattgaggagttaggggaggagcggcggagggacgcctgccagggatgccgcctgtggtgtcaagcgggatctctgcctgtgctttcggctgccggccgtttagtctagttcccgtagggataaaatagaaaaatctgatggaaccagcgacatgcagcccacaatttgataattgtgggccttagtcgcctcagactttgcttgggaaagcaaagtctgtccatcagatttttctattttatcccaacgggaacacgacacactttgagacatccaaaaacacaggcagagatgccgcttgacaccacaggcggcatccctggcaggctgcgctcatccgggaggaagatacctaactttagggggatttcttacgggagaggcggatggtcatgggctagggagcgaattaatctgtcctccaatccttccgtcttccccaggcagcagtgtccctaatccccattaaaagtccgcagcccgcgtctgcggagccccctctgggggaagattcttaactaccgtatccaggatagcccggccacgcttccgcacagcgtcccctccgagccatctaacaaatctctcctcctagcgttcacggatatcaatatctccggagtcggcgtagattctgatgagcttttgttctgttccgtctgtctggtagtattcttcagagtcgtccctgtccctatagtgcccttttggagcgttctcgggaaggtagatctggccgtattcggctgtgatgtcaaaggtgtatgtctccaatttttctggaagatacaggtccacatccccgtattcactgttgcagctcagggagctgagtttggctgcgtccaggtaaagactgccggaatccagctgtatttttgcagtatcacatttgaaattctctatggtgctgtccccatatgcgctgtataaagtgaacgcttcggtttctgtgtcttttagttccaggtcgccgccgtcaagagtcaatttcagggagcttgaactgctttcttttaaggtaaggtcaccgtaatctaatgaaatatccatatttgcagcattggctccggttacggatacatcaccggaatcgtcgtatattttcagtgcgtcaagggtcttatcttttggtacatataagttgatataggtgttgagcgagtcgccgactgtggagaaggcgagaaatacaccgtggttctgatctggctgatagagggtgaatttaccatcagttacattatacttgggatttccgaatgcctgatccaacaggtattctacataaaagttattgtcttccgatggcagaacccggatatcggcataggcatccatggtgatttctgcttccgtgaaggcttccagcttcgttttttccagcgtgacgggatcggaagctgctgagttgggatgaatcccgcctctggagaaggagactccggccctgcctccaaagagatagccgattccggcaagcacggcacctgccgccatgaggcagacagagacagttataatttttttagtgattgctttcattctttttaccccctttagagatatttcccagtgatttagaagtctttcctaaaaaccagcggcagaaattgacagccccataaacaagaagcactccggcgcccagtgcgaataagccgaatccgatggttgcaaggccgtctgcaaatgtggagaaaagcagaataccacctccgaaaacgccgacgataccgcttgctacaactgccactgcagccaggaacaaacaaaagattacggccagaatcacgattaaaaagcagataaatacggccagcagagcgaaacccagcggaagcgcaattggtgcggcacagatccccagaatgccgatccagatggcggatagccctcttttgacagtcttgggcggttcctgtacattttttgccgcaaggtctataatcagctgatttgcggcatcctcgggggagccgagatcctcgattgcctgctgctcgaattcgggtcctgcctcggcaaagtattcttcgaaatattccatcgccttatcataatcttctttgggaagacggcgcagcttatgtgcgagtgtcctcatatattctgtcttagtcattgcgaaatccctcctttaacaatctcatcaattgttgccttatatatttcccattctttcattagttcctgatgatgtgtctttccgatctctgtaatcgtataatattttcggttgcgcccctgatactgctggtcataagtctctacatactgactatcctgcagccttttcagaattggataaagagtagaatcctttgtgttggcagcctttttaataatctggctgatctgataaccgtatgcatcattattagcaattaccgataggactagaaagtcgaacatcggggtgttcagtgtaaaggtcatgttatcattcctttctatatgtttttgttttacatatatgttttataagtatattatattcagtataatatatattgtcaacatatataatctaaagaatttcaaaagataatctttaggaggactttcatattgcagctaacatctaaatcgggatttagcgacgagctttagtctcggcgcggatggggacgctccataaagggatagccgaaaacctcccggagaacatccatgtcctttcaaaaacgcggccgcggacctaagaaattctaggcgggaaacagccctgaaaatggagcaccactgacacatcacgagaaatccgatgatttctcgcgctgggtcagttgatttttggattcggaatccaaaaatctctccattttccgggctgtttcccaccaagaatttctaagatccgcggccgcgtttttgaaagggcatggatgttctccgggaggctttcagctatcccttcatggagctggcgcatccaaccggcaggaaaaagctcgtttctaaggagaggcctcaagcgggggcagcgtatggtattgaattggcgggacttttatgcccccagtaggtgtacataagcaatgggatacgaaagactcgttcctaaggtggagcccgagacgggggaggcggatggaattggctatgagtatcatgcatcttgattaaatggattttaaggcttttatgtatgggagctttgggactgtttttgaagaaatctatttatttagtaacgattatcgtgtgtaactccatatgattttttattaatgaaccatacaattttttaaatcctgtatatttacgggtaacaaggcgatctaacacttacacttatataaacgaatcaccaattctgttccatccgttgctaccgtacgagggcccctctggggaatgagctcttaactaccgtttggatgcaacagcgaatgacgaggtgagtccgggagctggcggggcaatgtctgctggtgaaaagtccataaagcgagcgattagaagctgtagaagaaaacggaacggaagggagggcagaatttgccttaccaggcaaattctgatgccgcctgcggcgcgaatgcatcggcattcgggccaaatgcggcatgtacctcccttcccgttccgttttcttctacagcttcttcgcgaagtgtcaggacatttcaccagcagacattgccccgccagctcccggattcacctcgtcattcgcgtccgccatccgtcaacgagtctaaagctcgttaactaactcccgatttatatgttgaccgggatacgaaaagtaatgatttaggtattgtgatatgcaaaagaagcagagtataataggagaagaaagatgacagtaaataacagaaattgtgtgagagttgcacaggggtctgacccctttgcaaaggagagggcattatgtataagattttaattgtagaagacgatttgacaattgcgaaaacgattgaggcacacctggtgaaatgggactatgaggtgagatgcatcaaggattttaaaaatgttcaggaggagtttattgcatttgagcctcagcttgtgctgatggatatactgctcccattttataatggattccactggtgcacgcagatccgggcgatatcgaaagttccgatgatcttcctgtcctccgccagtgataatatgaatattgttatggccatgaatatgggcggagatgattttattgagaagccctttgacctgaacgtgcttacggcgaagatccaggctcttctgcgcaggacgtattcattccagggacagttgaatgtgctggagtacaaaggcgtcattttgaatttgaacgatgccgctttaacatacgagggcaggaggctggatttgacgaaaaatgattttaaaatcctccagattttgatggaaaatgcaggaaagattgtgaagcgcgagcggattatggaacgtctttgggaaagcgatgagtttatagatgacaatacattgacggttaacattacgaggctgcgcagaaaactggagggaatcggaatcacggactttatatgtacaaagaaagggattgggtatctgctggaatgaagaaaaaactgggcttttttataaaatcaagattaaaatatatggtcttgttccttgttatattgggaatattctggtttgtcctgtacctgtataacatcaggtcagatgcactgagatatgcggtactgctttctgctgcattatttgtagtttttgcagtgtgcgattttgccggcttcttccgccatgttgaaaaggttaaggaagcgcaggcggctctgccgcacgaattgagagagacgccttctacgacagatttgacggaattactataccgtgagaagctaaaagttctgtttgattataaagaagaaatggaaacaggagcccgcattggaagacaggagatgctggactattatggcctgtgggcccatcagattaagacccccctggcggccatgcgcctgctgcttcagtcatttgaggaaggggagattgaggaggaggctgagctgatccgaccgatgaagatggagctgttcaagacggaacagtacgtggaaatggtgctttcttatctgcggatgggggatatgtcatccgacctgtcactgcagtggtactccattgatgatatcgttcgccaggcggtgcgcaagtattctcagcttttcatattgaaaaaaatccatctcaattatcaaaaatgtgagggaatggtattgacggatgaaaagtggttccttctcgtcttggaacagctgctgtcaaatgcgttgaaatatacagatcagggtaccatttccatatatatggagccggggccggaagaagtgcttgtaatagaagatacaggcatcggtatccaggcggaagacctgcccagaatatttgaaaaaggatttacgggatataatgggagaaaggataaaaagtcaacgggaatcggattatatctctgtaaatccatctgtgacaaattaaaccacggcctgaccgcggaatctgaagtcggaagagggacaaagatacgactgtatctacaccgggaacttctggttacagagtaggaagaaactgcggtaaagaataaagtgaaaaaaagaagttctgccatgaagattcccatcatggcagaactttttctttgaatgataaaacgccttaacgctgcatttctttacatcagtgcctcaaacagtttttcagtcggccgtggaataaccacactgttaaccatcagttcgcttacagcctccgcagcttttactgcagccgtcacagcgctgacatcgccgcacatggtaacaaatcccttgccgcccacggcaaaaccggtgcggatctcgatcagatgaatatcggcagctttcgcagcagtatccgccgctacaattgcagaagatacggaatagaactcgatcacgcccacagctccggtggtcggaacctgtgaggtattgctgatcgccggcatcagctggtcgctgatattggggatcagcagtttatctaccaggaatggtcctgctatctcttcccctacgttcatagcagcattcacgctgctggtatcaccgccgataatgatcagatatttaccggggcagatcgtggatgaccttaataattcaacctctgcggccttgagtacatggtcgcaggtctcaattcctttcgctatactggacaattctaacattcctactgaatttcccatttttaaattcctccattagtttacatttattcgaataccgtttggtgctgcttcggtgactgttccgttcacgcttgcgtgaatattagctgacagcgctttttcatctgcctgtccgattaagtcgcctttatgtatggtgtcgccggctttgacaactgctgccgccggcttgccgatatgctgtgataatggaatgaatacttccctgggaaatagttccgtacagctgtgtgcatgcagcccattatattttccgagccccagacgcgcgatcaggcggtcggttggaatccggttgagatcaatcgtcggccttgccgtaggatccggagtcttatcgatcataattccgcgttcacgaagctgtaccttcatataatcattcacttgtctcggggaaagtcccattggacatgagaacatctcacagacgccgcagctgcagcagttcactgcatcgccgtagcatttcgcgaattcttcgttggaatcaatcgtctcttctctccagacatttctcattacaagatgaggcttgatgctgtgtccgatctggaaacgcggacacagatctgtacacattctgcactggatacaggcgcttctcgcctgatgcttaattctctggatggaaacctgtgttctcctgatcagataatggtccttcgggagaacgatgatgttgccggttgtctttgttacgacttgctggtcaatggcgctgtcatctgcaaagacctttcccatcatagggccgccgagaatgacggcataatcggagatcgcaggctgcgccgcctcgatgcaggttctgacggatgttccgatgggcaccttcagcatgatgggttccttcacttcaccgacaacggataaatacttatccgttaccttgtcaccgttcgtcagcgcacggtaaatcccaagcacggttcccacattatccacgacggcgccgacttcaatcggaatgccgcgctcagggacggtcctgccggtaacctgctgcacgataatctgttcatccccggcgggatagaaggttctcatctcaaaaatctcgatatctgcattatttttttcaattgcctctcttaaagcggcaatttcggctttgtatttagctttgagcgctatgtaagacttctttgcctcgagatgtccggcaatatacatgactcctttaattaactcatcggcaaaggttctgcacagatatttgtcagtctcaatcaatggttcacattcggcggcattgacgataaaatactcggccttagtgttcaacttcacatgcgtaggaaatcctgccccgccggcccctacaataccggcatcttttactgtttcgattaaactcatagcttctttctccattcattgattttcgcgaaagcagcgggcccttgccgggataatcgtgcaatacacagcgattccggggagtcagctgcccgcggggccaaaggatatttggcctggtggacataggttgtgtttatctgataaaataataacacagtgccatcatatcatatttttcgtaaaagaaacagagaaaaatgaccgaatcttacaaaaacgtaaggattcccccgggttttgaaaggcaaagttatggatggagacagtacgggtgccttataatatgtgcatagacaggaaaacaaggaaaaaagaaaggcaggaaagctttatgtcattattagatgtaaaaaatgtaaaaaagatttatacaaccagattcggaggcagtcaggtgcaggcccttgcagatgtcaccttttccatagagccgagggaatacgtggcaatcatgggcgaatccggttccggaaaaacgacattgctgaacattctggcatctttggataaacctaccagcggaaaagtactcctgaaaggacgtgacttaagtacaattaaagacagggaaatggcggcattcagaagacagaacctgggcttcgtcttccaggactttaacctgctggacaccttctcactggaagacaatatctaccttccgctggttttggcggggaaaaaatacgaagaaatgagacagaggctggagccaatagccgctcagcttggaatcacagatttgctgaaaaaattcccctacgaagtctccggagggcagaaacagcgtgcggccgttgcaagggccttgattacgagacctcagctgatcctcgcggacgaaccgacaggagcgctggattccagggcttcggatgacctgatgaatctttttaacacaatcaatcagaacgggcagaccattctgatggtaacacacagtgtaaaagctgcaagcagtgcgaaccgcgtcatgtttatcaaggatgggcaggtctaccaccagatatacagaggcaatcagacaaacgaggaaatgtaccagaagatttcggcggcgctgactgtcttaatcacagggggtgagcagtaatgttttatccaaagcttgcatttacaaacttaaaaaagaacggaaaggtttacatcccctacctgcttacctgtgtgctgacagttatgatgttctacgtcatgaatgccatcagcagaaacaccgggctggatcagatgcagggcgcagatacactgaggctggttctgagatgggcggttacgattacgggaatattttccgtggtatttctgttttatacgaacagtttcctggttaaacagagaaaaaaggaattcgggctatatcaggtgctggggatggataagggcaacctgacaaaaatgatggcatgggaatcaatccttacaacccttatcagtatccttctgggtctggtgctgggtgttctgcttggaaagctcatgtttttaattttattaaaaatgatccattttaaggttccactgaaatttgcagtagaaccggcggccatgatcggcaccattgtattgtttcttatcacgtttgtggtaacttttatcttcaatctgtttcaggtgcagaaggccaacccgatcgagctgctgcacggcggcagtcagggagaaaaagaaccaaagacaaaatggctgctcgcgctgattggggcggtgacccttggaatcggctactatattgcacagaccacggactctccgctggcagccattggaaagttcttcatagcagtcattctggtaatcatagggacatactgcctgtttactgccggaagcattgctgttttgaaaatcctgaaaaggaataaaaagttttactataagagcaggcattttactgccgtatcgggaatgatatacagaatgaagcagaatgcggtgggacttgcaaatatctgtatcttaagtactatagtcctggtcatgatttccgtttccgtttcgttatatgcaggtatggagaatttgctggcaacgcgttttcctacggacatggatgtgatggtttttgacgcgtcacaggaaaatcgggccaagacggaccatattatagaagaagagacaaaaaaggccggggtaaagataggagaccgtagatcttacagttccggaagttttactgtaatatatgacgaaaaaaacagtacggttctgctggaagaaaagacggataaatcttacacaacagaagatttcagatggatggaaatcatccccttatcagactacaacaggctggagggaaccaatgagacactggagcgaaatgaagtactgatccatatgtccggtggagaatggaactcagacgtgttacagatagaagatgaatcctacaaagtaaaaaaggcggtcagcctgaaagaagaagcagagaatgaagtttccggcgcagtagagggaatggtcgtagtgatgtcagatatacagcagatcgcagacctaaaacagcagtacggctatgaaggcgcagacacgatcatctattccgattccttcaacatgagcggaaaggaagaagataaaaataccgctgcaaaagcaatagaggagcgtctggcaaaggaggttgcagaatcacgcatagagtatagagaagcctacagaggagagttttatgcaatatacggcggtttcttattccttggtgtatttgtaggcgcattgttcctgatggccaccgtcctgattatctattacaagcagatatccgagggctacgatgaccgcggccgctaccagatcatgcagaaagtgggaatgagcaaaaaagaagtaagacgttccatcaaaactcaggtactaatggtcttcttcctgccattgatcgcagccattattcatgtaggcttcgccttcaaaacggttacaaaattgctggcggtcatgaatctcacaaacgtacacctgtttttcctgtgtaccgtgggaacggtattcatattcgcagtattttacgcagctatattcctaataacctccaaacaatattataggattgtgcagtgaagtcgcgggagcggatgagcggacgctttaggaaccggagataggggcatctggagacggggtacgacggtaaactggagtaaagtaaaatagaaggaaaaccggggcaacctggccacatcacgcgaagccctgatggcttcgcgcgctggggccagggatttttgtgattcggaatcacaaaaatcaccccggttttccttctattttacttaactccagctaaccgccgtaagacgcctccagatgcccctatctccggttcctgaagctggtgcatcaaaacggtagaagtggcttcactgacgggggatcttggcgggggcagcggatggaatcgatgaagcgggaatgaatggctggggtagtatatatcgtaaaagggcaggatatctacaaaggtaatgggggctttgatatccgcgtagttagtttaatccgctgttaccgtgaatctttctgcaggcggcccgtttgcaggaaggttccctgaagtttccccgcctccgtagtccctcccgccctagataggcgaatcctttcccaaaactacttgattatatgatataatttggggaacaagtatttgtcaggaggaggcgttttatgtctgattatagagaggctattgatgtggtgcttcaagaggttggcagggccgttgttgggaaagaggagattacggaaaagattatgatggcgattctggctggggggcatattttagtggaggatattccggggatgggaaagaccaccatggcccttgctttttctaaagcgatggggcttgaggagaagcgggttcagtttactccggatgtgcttcctgctgacctgacagggtttacgctgtatcagaaagcgacggagcagtttgtgtaccagccgggtgctgtgatgtgcaatctccttctggcggatgagatcaacagaacctcgccaaagacgcagtccgcgctattggaggttatggaggagaggcaggtgaccgtggatggggtgaccagaaagacggggaatccttttatcgtgatcgctacggagaatcccgccggttctgcgggaacacagctgcttccggagtctcagctggatcggtttatgatctgtgtcagcatggggtatccaagcgtgaaagaagaagtagagattatgaagagaaaccagtcagggcgtagcaccggacctgtgagacgggtaatgacggcggagctgcttttgcgggcgcaggaagaagtgaaaaatctgtttatacatgacgccgtatacacttatattgcccagctggcaaaggcaaccagaggcggagaatacattgcaatggggctgagcccaaggggaaccgtggccatggcggctatggctaaggccggcgcttatatgagaggccgggagtatgtgattccagatgatgtggcggatgtgtttcaatgtgtggcagggcacagggtactgctcagcaccaaggcaaaggtcgggcatatccggacggaagacgtactggaacagatcctggaagaggtgaagccaccggttatgaaaaggcgttaggtggcggcatgataagacgaacactaggatatgcggcggcggttctggtaaccgggtatctgttcctgatgtatgatactccggccctttcagcagctttagtgctggaaatcctgtacccctttgtctcagttgcctgtctgcacaacatgtctgcaaggttgacggcggggatcgggaaggttccggctatgggggagaaaaaccagaaaatcagggtgaaattatgggtaaataatacttccaggatctggaatgggaaatatgaacttcgggtgaagatcggcggaagaaattccggtcagatgatggtaaaaaagatgtccggaatgttggagccgggcagaaaaaaagctcttccgttttattttacatcggaatactgcggaagcatggaagtcgcgcttgtcggtatgaaaatttttgacttttttgggatgttttacagaactatccccgttgcggacaaggcttatgtagggatcatgccccgaaccggcctgatgccgctggaaattacgagacggacgcgggagtttctggccgatgcggatgaatattccgtagaaaaaagcggggatgaccccgctgaaatctatcaggtcagggaataccggccatgggactctgtgcacgacatccactggaagctgacggccaaagaagatgcactgatggtgaaggaatacagctttcccctgggatgcgttgtgctggtctggatggagtacccaaaaaaagcacagagcagcgaggggttcagtaaaatgctggaatcagctgcctccctgtgcatgacgctggtggaggaaaaatgtattcatatggctgcctggtttgaagaaaagaatatgagaattgtgaaatggaaggtcagcagtgaggagaccgtgcacggccttctgtggagaatgctggatatggagccgtatacggatgacagcatgcgcaaagcctgctatgaagatgcattccgcggggagcatttcagcagtattgttaatattgacggacagggcgggataaccgtcaatggtgaaaagcaggaattactgcagctgtagggaggagactgccgatgaaaaacagaaaagaaggtaaatcaggcatcaggctgtttgaacagaagagcagagagatatccggggaaatgaaccggattagtctgtttgcggcaagggcattatctgcgggttttcttgccgccgcatggtgggagagcctgctgtccgtgttccccctgcaggtattaaaaccctgtttgtatggctgcctttttctgttgtccgtattctggctgtggctgtggggaagcaggggaaagaaaaaaattctatatctggccgcaggaggcgcggccctgattttttttgtatggaaaaatcgtgtgcctgcaacagcggtagtgaattcactggcgaatgcctatctgcgtattcatgaggagggcagtgtgccgctcctgctctatgaagtgcctgagatttccaatatcctgctggccgtagggattgcagcagccaccataccaatcatagcggtgttttccctggttctgctcaggggaaaaggaaaagcggctgtcatagtgctgcttttctttccggttatcctttctgccatggaaggttattttccatctgtgaggtcctgtggtctgttggttatggcctgcggtatctattttgccatagggacaggcagtacagggagggctgcctggggaaatgcggtgacagctgcagtgctggtctctgtgctctgcgcagtctcctggggagctgcaggcaggatagaggtacaaaagtccgcagaaaatgggttgtatatccaggcaaaggcagtaatcgagaaacatgtgatccagagactggaagaggcctccggtgtatcaaaagaagaagaaccaaaggaaaaagaagaagcgaagccggaaaggcctcaggatactgcaccggagaaatcccaggataacgaagtacagaacaatgaagatacccgggaaggtctgtttccaaacgaaggaggtacgactgccggaatccctcacgacctgttcgctccggatcagtcaacaagcctgcagaacatcggatatttccggccgggagacggaaacggacttgttgtagcgtctccaacccgccccgagagcaccgtttatctgccgctgacgtacggcgcagtctatcaggacagtacttggaaagctccggaagaaaacggtgagataccaaatcaatatagaggatatccgggaaatctgacccgtctgatcaacctgtgcgaaaaacaggagatccattcagtagaggaagccgcagaatttatacagaaagagtttgaggaaaatacagtatacgattatcagcccgggcccactccttcggggcaggacttttccgaatactttctgtttgaaaacaaaaagggattctgtgtccattttgccacaacggccgttctgatgtaccgcatcatgggatatacagccaggtatgtcgagggctatgccatccctccatcggcgtataaagagcagccggacggttcctaccgtgcagaagtaacgggcgacatgggccatgcctggtgtgaaacctatgaagacaaatgggtcataagagagcacaccctcccgtataccggagacagccaggcagcagtaccgcccgcatccgccagcaaacccgcagtaagccgtcaagccttatccaaatcagccctggccatcctgacagccttcctgctggtattcctgtgcacaatcctaacagcaacacaggctgccgtgcggagaaaaaagaaagcaaacgccatacaaaaatacgcccagggcaagggcataaccgagatctaccttgccttctgtgcggcagcagccgtccttggcacaaacataaaaaccccgttcagtacagattccttcgaaacccttaaaaaagccctgcctgtcctgaccgaacaagactgcaacaccctccggcaggccgcccaaaaagcaatgtacgacaaaaccccgcccccaaaagaaacccaccaaaacttatacgccctttaccaaaaaacatcaaaacacatccaaaaagacctgcccataatcaaaaagatccaataccgctatataaaatgcctgccataatctaaattaaaagaagatataagcaagcaaaatccccttgccaaatacagccctgccatccatccccacccgcccaagccacaaaataccgatcggacatccccctggcaggatgcacccagctttgcggaaggcgaaccgggaggggccgggaaggcgtgtgctgttttgcattgcgccccctcccttactacttccgccgcgccatcagtatcctgataatcaatccgatgatgagcaccccagagaccgtataccccaaaaaactgatccaaggtatcccaaaccactgtggaattgtgcgtacatgaataatcattccggagcctatgaacagagctgccgccagtatactcagaacaaaacggtcagccgttttatgaatatcggcgcgtatctcttcggaatcagaaagctgcagattcagctgggcctgtccattcttggtaatattgagcagatcagatatctgtgccggaatctccatggacttatccatagaagtatagagctggcgtcctttatgcctgagcagtttttttatatccagttctttcagcaggagcgaggacatgtgcatagaaagaatctgcagaatattgacgtccggggcacaggctgccagcgttccctccatcgtgaccatgctccgtccgagcagcgtaatgtctggggtaatagccagacggtgatcctttacaagagaaagcatgcgctcaattaattctcccagcttcattgttccgaaatccatggacatatatttgcttaaaatatcatcaatgtctgtataaagtctggcatggttgacgcgttcctggggttccccgaatgccagaagcacatttttcagagaatagatatcgtgttccagaatcgccgtgatcgccttcttgagcagctgtttgttgtgctcagtcagcctgcccgtcatccctaagtcaagccaggcgatctgtccgcctgctacccagagattgcccggatggggatccgcatgaaaaaaaccatcctcgagtatctgcttacagtaattttcggcagccttctggccgatctctgtcatatcatagccaagctctttgagacgttctgtctcgtcgatctgtattccgtcaatatactccatcacaagcagccggggagtagtaaactcgtgaaatactcttggacaggtgacatacacaatatccttctggttcacataaaaaagattcaggtttgcagcctcctgaagaaaatctatttcttcccgggtggtcttccagagttcatccagaatcgtcctgaaatcaatcaggtcttctgtcccaatagccaatttcagaatgccggcagcttttttcagaagcaggatgtcgtcctgcatgatctcttttatggccggccgctgtattttaataacgacttttgtgccatccttcaggaccgcggggtgcacctgggcaatcgaagcagagccgagaggtgtctcctcaatctgagagaagatgtttcccgccggctctttgagttcttcttcaatgactccggacacaacggaatagggcagggggcttacctctgtgcgcagcttcgtcagctcacggcagtaattttcaggaagcatatccgaacgcatggacataatctgcccaagttttacataagttgggcccaaatcttccagaatttcgcgaagcttggccggggtgagcccatgggttatgcgatgtttaccaagtacctgcatgatctcccgcaggcgcttttgggaagctgggggttctgcctgggatgtctccggggttacgattgtttcgttcataggcagaacctgctattggggatcctgaggggcatcagcttctgcttcctctgcagggctgtcctcagtgcaggagtcctcccctgcagggccgtcctcagggtcggcagctttctccgctgctttacaggagtcgccgttatccgcatccatggccccgtccccggacttttcctccgcagcctcttctgcggctttctctgcagccttttgtgctgcggctttttcgacctctgcgattttggccttgagtgcttccagctcatcctctttcatatggtctactgcggtcattgcatctttgtattccttcacaactgtgacagatacatgctccttcatcttttccctggcgttttttttcagttcttcattgagtacttttccctgctcaacagtaatctcgcctttttttaccagattctcaaccacatcttttgccgtctctgccgtagtggctatcgcaccgacacccgcaagaaatattttctttaatccttcgtttaattccataaatataccatcctttctggagaattcagtcaattagttatagaaatattataccacaaatcatggagatgatttcttaaaattccataaggaagttaagaggtcattttttacggggccgtgtaccacgctgcacggcatttgagacaataaagtgatagggtaagagtagaccttttccgggaaatatgataatatgagggcagcggagatggcgaaggaccgtgctttttcgtgccgagagtttgtggaggccggaaatggcggccaggaagagctgcttcgaaagaaagacatttgaaggatacaacaggaggcatatatgatacgagaagtgagacaggaagacagagaacaatatttgaagatggcgcatgatttctaccattcaccggcagtgctgcatccgataccggattcatatattgagaaaaccttcgaggaatgcatcagcagcggaacttatggaaagatctatatgctggaacatgagggcagcatggcggggtacggcctgatcgcgaagacattttcccaggaggctggcgggtatgtgtactggctggaagaactctatatcttggaagaataccgctccaaggggctgggaagcgaatttttcgcatacatggaagcacacagagaagaaggtgtcacacgcttccgcctggaaatagaagatgacaatacaagagcaaaagccctttatgagaaactgggatatcaagatctggattaccggcagatgaagaaagatttttagcatacatgtataccttattctgcagctttgctgcagacccgcccgcagggcatgagttgcggggtgccctttggatatgcaatgttttatgtcagatcgagaatgggtttaaagcacagattacgcgcggaattagcctaaatatacaacaaagaaaaaggaggactttaatatgacaaaagcaggcgaaagaaagattgagacagtagaaaaagcaaacggaggtgcaggcttcatcatgaaggaagccctgttaagcacagaagagcttggaaaccactgcaaaatgttctcaagagtaacgctcaagcccaattgtgaacttggccatcacgagcatcacggagaaaccgaaacgtactacattctctctggaaagggaatgtatgatgataacggaaaagcggtgcctatagaggcgggagatgtagtatactgcaaaaacggagacggacatggagtcaaaaatacggggggagaggatcttgtttttgtggcgcttatattgagggtgtaggacgcctgatgggagcgggccgctgcgatgctgtccggggaggcttatgctgatcctggaaaccggccgcttagcctacaattgctaactgtgaaaaagccgcagcttatgggaccgagcatattcacttagaaagcctgatgctttctaagctcagatgctctggaaaactgatttggaaatcagttttcccccataagctgcggctttttcgcagtaagcaattgtacggcacgctaaaggcttccagaatcagcataagcctccccggacagcatcgcagcggcccgctccgattttgattagcggcgcttacgcactgattccgccgccagaagagccctgttccacttccgtacagcgtccccataccaacctaccccaaactccttcgaatcccctcaataagcctagaattctcctcccgccccattacacaaaaccgcacatattctccctccaggcactgaaaggaagaacagtcccggatcatcatgccctgtttgatacaggcctcgaataggtcaaaggcagtcataccgggtttgcggatacggatcaggatgaaattggcggctgcgtcgtagacggtgatgccgcttattttgtgcagttcttccaacattcttgtgcgctcagcttttattaaggagcgggtttcttctatataattagtgtcctgcagcatcagttctccggcaaaggcggcgatgctgttcagagaccagggaatctggtgctcctttacccgggccaggaaggaatggctgctggtgactccgtaacccaggcggaggccgggggcggcgaagaatttggagactccgcgcagaaccatgaagttgtcaaattcttcgatcagggacatggcacttacggaagagatatctggggcgaattctacataagtttcatcaatcataacaaaggttccggccttctgacagacggacaggatgctgcgcatatcagaggtgcctatgactgaagatgtaggattgttgggattgcatatgatcaggagatcatacccagcctcgagtctttctagaaaatcagagatgttgaggcaaaacccagtgtcgggattcagatggtagtaatcctgcgtactatcagaaaacgagagttctcttgcatattctgaatatgtggggcccagtatgagagtttttttagggcggcgctgctcaataagcaaagagattagttctgtagatccatttcccaccatgacatgagcgggggatacctgacagtattcgccgatggcgcagcgaagggaggtatattctctgtccggataggtggaaatgatatccaaatgacggctcaaagccgcttttaccttccgggataggcccagtgggtttacattggcgccgaagctgattatggaatccttaggaattccgtagtattccgatattttttccaggtcactgccgtgaaattctggttttgtattcatgtatacgatcccctttcaaattctttcattcacccgttgcaagaaatagtataaagatgatataattcattatagcgtgcttatgaaaaaatgcaacgaaagaaatatgagtaggtgactaacttgaagaataagattaaacgtctttccaaaggagattttcacattccgcagccggagattattttccccgagacacggattattatgcgtgtcggcgagggggagatgtataagggcagtttttccctgcagaaccagggcgaggggaccatcagagggttggtatatccctcttcttatcgtgtccattgtgaggaacagggcttcgatgggaacccggttaatatctattatacatatgatggttccgggctggtgccgggacatgtggaacatggcaggtttaccatagtgtgtaatggcggggaatatgatgttgcatttacggcaatcatagagaagccctttgttatgacaagctatgggaaggttcagagcctggaagattttaagaagctttctttccgggatccggcagaggcggaaaagctgttccgctccagagatttttacgagattttaaaatatgaagataaacgtatccaggccctttacgacaatatgcgcaaatgggagttggatcagcaggccctggaggaatttcttgtgggctgtaagcagaaagaaaagatatttctgaccctggaagaggagagccgcgcttttatggaagtggaagaggctcgcaaagaaactctgacgattaaaaagaatacttggggatatctttctattgacgtgcagacggaaggagattttttaaccgtagagcacgtgaaggtgaccacagaagagtttatcggcaattcctaccgtttggaatatattatcacaccggagcatctgcaccggggcagcaatttcgggcagatcatgctgcagacaccttatgagactctggcctacgagattgtggtggagaaggatgtcaggcgggaggaggaacaccgtgcgggcgatatggaatttaccagcattgtgaagcggtatctgacttatgaggccggcaggatagacctaaatacctggacagaggaatccctgaaaaagatagagcatctcagggagaaggataataagaaggagatgtatcttcttgtacacgcgcatatctgcctgcttggaaaacgcatggaagaggcgaagtggattctggaatcctataattataaccggtttgcaattggcaagaatgttgagatgagttcctactatttatatcttacgaccctgctcagcaatgattcgatcgggcagcgccgggtggcagaggaactttccaagtcctatatgaagcatccggagagctggctgattctgtgtatgctggtcaatgtagactccgagtataagatatacagcgaacgcctgcgtgcactggaacgccagttttatgaggagaagacgcacagcatctggttctatatggaggcatttaagtgcttcagggataagagttcctccctgaaaaagctgggcaaattcgaggttatggtgctgtattttgcggcaaaatataaactgatgacaaaggagctggccctgtatacggcgaatctggcaagccagctgaagaactttgacaggcacctgtatgagaccctggtactggcctacaagatgtatgaggaaaacatgatccttacagccatctgtacccttctgatcaaaggaaactgtatcggctacgattattttaaatggtatgaaaaagcggtggagactgagcagaagattgcacagctctatgaatattatatggcttctattaaggaaagccatttccataaggcactgcccagatctgtgtacctgtattttatgcatggaaacacgctggactaccgaaagtgcgctctattatactccaatttgattacgtatgaggatgaatccagcgagatctatgcgcattaccgggatgagatggaggcttttgcatggaatcagctggagagacggcacatcgacgaacagctgaggatcatttataagcgctttatcgtggagcgttccatgaatccggagcgcatcaaggcattatatgatatttgccacgcctatgagattacaaccaaggtaccgaacatgaagttcatccacatcatagcggatgacggaagcattacccaaaaggtgccgtatacggaccggggcgcccaggtcttcttatacgccaagacagacaggcttgtatgggaatccagggacggcaggcattatacggattcaatcccttatgagagcagacgcatgttctatgaactgcgttatatggatatgtgcaagaagtatatcaacagcatgcgcatgaaccggatggaagaggcagaggaaacactgactcttgatattgtgcgggaaaagggcgttgagaactatgaggaagaggaattattcagtctctgcagtaagaacatcagggagaataactacgaaaacgatgattttctgacctatatctgttttgaattattcaaaaaaggtcagtatgataaggtgatcctgacgtatctttccaattattactgcggcgccacaacggatatgaagcggctctggagagaggcgcgggagtatgaggtacatacgcataagctggcggagcggattctgacacagatgctcttctcggaagaactgtttgcggaagtgcaggtgttcgaggaatactatgcggagggcgcatatttcagactgcagcaggcatacctggcctatatgtccaggggctatgttgtggaggaaagaaaaatcagcaagagcatcattgatattatatgcagagagtatgaaaagggagaggacacgatagatatctgtaagattgcggttctcaagtactattccaacagagaatataattcgatgatacgcaagaccctgaagaagttcctgcaggaactcagcggcaagcagatttatttcccgtttttcctcgcatatgagaaagactggctgattgaacttcagctctgggataagacgctgatcgaatataaggggcagaagggcagccgtgtcatgctttactatcagctgcagaaaggggattccgaggaggtggattactccaccgaggttttgactccgatgtacgagaacctgtatgtgaagaagtttgtgctgtttgccaatgaaaagctgaaatactattttaaggagacaattgacggaaatacatacaggagcgataaggaaacctgtgtgaaagaagtaaagaaaggcgaatcgggaagatacggacgtctgaacgacatcctgctggaggatggcagagagcgggatataaagatgaggtcatatgcggcggaggatgcgattgccgctcatatgtttgaacaatattaatggaagatgatggttactgttcacaggccagcctgggatcggtaacatagaatgtcactatgccgccgggaggactgggacatagccggcagaaagtacattgcggccgaggggcaaagtaaaagccccggcggtaaaggtgaggaggctgtctgtaatgggacaaggcaatataattggatatgagataaatgataagacctgccagatcagtttctacaacgatcagcagctggagccggagacactggaggtggattctgataattaccagatccccctgattattggtaaactcagggatacatgggcttatggtaaggaagcaaagcgtctggttacaattaaagaggggtttacggttacgaggctgctggacaagagcctggcaggagaaaagattgagttcggggaagagacttatgatgcggtctggctgctctccaagtttgtgcagatgtcgctgcagtcttttccgcagattgaggggatcgtgttttctgtcccggaactgactgaggagctggcccagcttctgcgtgggattgcggtacgcatgaacatcgataagaggcacattttcattcaggattataaggaaagtttctgtaactatcttttttaccagcctaaggaattgtggcagtacgatgccgcactattctgctgtgaccgtaatgagatcaaggcttttatgttaagaagactgaagcccgggctgggtggggggaagacgactttcgtcacggtggacgaagtcgccagcgcccatatgaaagaattggctgccgtttatccggtgctgaatgaggacaaggcgaaggaggcggattcacgtttttgcaaatttatagaaagcgtatttgataaacgcattgtatcctcagtctttctgacaggagaggggtttgaaaataactggtatccgacctctctgcgcgtactttgtaatggaagaagagcttttatcggaaataatctgtacagcaagggagcctgttacacggcttaccggaagatgtttatgcacatagaagatccggtatatctctcggagacaaagctgacggatcagatcactgtgaatatgagagtagacggccaggagatgtggtacccgattgtgtcctggggagcgcactggtatgagtctaacaatcagtgggaagtgcttctggaggatatggagaacatagaactgcatgtagaatctctggtgcagggaactttaaaaacagaggttatttcgttggaaaatttcccaaagagaggcgaatattctatgcggctgcagatagagacgctgtttctggatgaaaagacctgtaaaatcacagtgcgggacgtagggttcggagaattttacctgcctacggattttcaggaagagaagattatacatttaggaggcaatgatgggaagtttaattctttgtcatgacaggcatgcaacgcatccttatgagattacaaggatccactgcaagatatttacaattgaagaattatgctattatctgtgcaacaatctctacctgattgactacacgatcatgaacgaacagctctgtacctggctggaggaagagatcggtatgccggaactggcaggaaatctcagggatgtcatccggatgcgcggttcagtggaaaagtttgtattgacgatcctgaagagctcccggatattcagggaaccggagatgatacggatccagaatgtgctggagcggctgaagaatcagaaggacattgagcgtcagaagtataagggcgataacctgctggagagcggggagatcgaggaggcgatcctcgtgtatcaggccatactcaacgaagaggcggatgaaagcgtggaccccaagttctacggcaagatatacgccgggctgggtgcagcttacgggaggctgtttttatatcaggagtcggccaggatgtacgaccgggcttaccagatctgcgaagactctgcactgctcaagccgtatctgtatgcgtcctataagtatatgtccctggaggaataccacatcctgctgactaagcatgacgactatgtggaagtcaacgctcagatgcgccaggagatggaagacattaagaagcatatacaaatggagccaaattccgtgctgcttgaaaaatggaaacagcagtaccggcgaagtcatatatagggggacgttccatgttaggactcaagcccgtccccaaatcccaattgacattcgaatagaagtatgttattatatgtacgattttagcgtggtaaagtaatcaatttgtaaaagaataaagcaccacgacagggagggcgtatctatgaagagaaaattagcagtagcaatggcagctgcacttgtgctgacaacagcgctggcaggatgcggaaacaaaacggaagataccaagtcagagggtactaaaacagaggataccaagacagaagattccgcaaaaggcgatgaaaagacagatgcagtaagtgcagaaaaaagcgagggagacagttttacggtagggtttgacgcaagtttcccgccttatggctataaggatgatgacggcgaatacgtaggatttgacctggatctcgcacaggaagtgtgcgatagaaacggctgggagctgaaaaagcagccgatcgactgggatgcgaaggatatggagcttagttccggcaccatcgactgtatctggaacggattcaccatgaatggccgtgaagacgattacacatggtcagagccatatgtagacaacagtcaggtagtggtagttgcagaagattccggaatcaaatcactggaggatctggcagggaaaatcgtggaagtacaggctgattcatctgcactggcagccctggagggagaccagaaagaactggcaggaacattcaaccagctgacacaggtaccggattataatacggcatttatggatctggaagcaggcgctgcagaagcggtagcaatggacgtaggtgttgcaaagtatcagatcgaatcccgcggaggcggatacataaccctggacgagacgatttcttccgagcagtatgcagtcggatttaaaaagggaaatgagaagcttagggatcaggttcagaaaacgcttgatgagatgtcagaggatggaacattcatgacaatcgctaaaaagtggggcgttgaagacgctgtctgcttaggcaaataaaatttaaaagtaagaatgaaaaaggtcagaattactatctggcctttttactacccggaggtcaggaagatgaagataagttttatggcaatgatcagccagttatcagggggcatgttaggaacagtagggatattttttgcaactcttttgttttcactgccgttaggtttgcttgtgtcattcggaagaatgtcaaaaattaaaatcattcagtggataacgaaagtatatatttctattatgcgcgggacaccgctcatgctgcagctgatggtggtttatttcgggccgtactacatattcggaatccggatcacggcgtcttacagactgagtgcggttttgattgcatttgcggtcaactatgccgcatattttgcagaaatttaccgcgggggaatcgaatctatgccggtcggacaatacgaggcggcaaagctgctgggatataaccgggtgcagactttcttccgtatcattttcccccaggttatcaaaagaattctgccgtcagtgacaaatgaagtaattacgcttgtaaaagatacgtctcttgcatttgcaattgcctatgcggaaatgtttacgaccgcaaaacagatagcagctgcccagacctccattattcctttggtggctgcaggtatattctattatgtgtttaacctgatcgtagcagttttcatggaatttatcgagaagaagctaaattattataaataggagggaatgtcatgagtctgttagaaatgaaacatatcaaaaaacactttgacgacgttgaagtactgcaggacatttccctgaaggtagacgaaggacaggtcctggcaattatcggcccatccggatccggaaaatccacactgcttcgttgtgcgacgaacctcgaaaccccggatgcgggagagatccattatgaaggagaatatggtctggtattccagaatttcaatctttttccccatttttcagttatgaggaacatcacagatgccccgatcaaagtgcagaaacgggaaaaagaggaggtctttaaggaagcgcgcgtacttttgaaaaaaatgggtctggaggacaaggaaaatgcttacccgtaccaactctcgggcggtcagcagcagcgagtttccatagccagggccctggctatgaaccccaaaatccttttcttcgacgagccaacctcggcgctggatcctgagctgacgggagagatcctgaaagtaatcaaagatctggccgcagagcacatgactatggtgatcgtcacccacgaaatgaattttgcaaaacatgtggccgaccatatcatctttatggataagggcgttatcgcggaacagggaatcccggaagaggtctttgggtcggataatatacgaatgaaagaattcctggggaaactctccagaaatgggatatagattacgagatttagccttggggggggggatggagagggggcgcttaccgcgagccgggacgtgctgccaaaagtgcctatcctgttggaattacagcccgctgcgccaagcagcagtaagcggaaatccgcaaaaccagacagaaccgaacacattcaccgcttaatctgatgattaagcgccttaggtgttctaaaaagctgcttcggaagcagcttttttctgtctggttttgcggattttcgctaactgctgctaggctcgctaatatgtaattccaacaggataggcacttttggcagcacgtcccggctcccggtaagctggactcatccagtcggcagggaagatctcattcccccggtggggattctaaaacgggggctgcggatgtggaatggctgcggggaacgtttttgagggggaggtgatttgcatcagtttttgcaaaaagtccaatatttcataaaaataataagcatgtggacatcatatacatagtcgatacacgtccgttactccggtctgggactccaaccggggaacgggctttttattaccggctggatgagccagctttatgacagggatgccggggtgggactggggctgtatatgccggtgcgaaatgctagaagcgcttagcagcacgggtgcattacgcaccggcatatacagccccagtcccaccccggcatccctgtcattaagcgtccccatctcaccccgggacgaattctcgtcctccaaatcccatattgattttccgtctcccttgtattataatcatcatgcgagactttgtttttcttttagaaagacagccttactactttatgtatgaaaaatcgaaaaaggacaggtgtgaacgtatgaaaaaattagaacagctttacgaaggaaaagcaaaaaaggtatttgctactgacgacccggatattgtgattgtagattataaagacgatgccaccgcatttaatggtgagaagaaggggacgattgttgggaaaggcgtgattaataaccgcatgaccaactatatcttccaggtgctggaaaaggaaggcgtgccgacacactatgtaaaagaactgagtgacagagagactgcagtgaagaaggtggagatcgttcctctggaagtgattgtgcgtaatgtggctgcgggcagcttttccaagaagcttgggattgaagaaggcagaaaattattagcaccgactttggagttcagttataaagatgatgatctgggcgaccctatgatcaatgattattttgcaattgcgattggggctgcaacgagagaagagattgataagattacggaatatacttttaaagttaatgacgttatgagaaagttctttgatgaagctgggattgagctgatcgactttaagattgaattcggcagattccatggggagattatccttgcggatgaagtgtcaccggatacatgcaggctgtgggacaaggagacacacgagaaattggacaaagaccgtttccgcagagatatgggcaatgtagaggatgcatatcaggaagtatttaagagaatcggcatcaaataaataggagacattcatgagcagaattgataaagttatgacaggcttgggggaagaatgtggagtttttggtgcatatgatatggatggcggcaatgtggcgccatccgtatattatggcctttttgcactgcagcacagaggacaggaaagctgtggtattgcggtaactgacacatatggacagcgaagggttttatcaaaaaagggcctggggcttgtgaacgatgtgttcgatgaggaatccctgcatggtttgaaggggaatctggggatcggacacgtgcgctattccacggcagggggaacccgggtggagaatgcacagccgctcgttatcaattacgtgaaagggacactggccattgcccataacggcaatctggtcaatgccattgaattgagaaaagaactggaatatacaggagctatttttcagactaccatcgattcggaagtgattgcatatcatatcgcgagggagcgcctgaatgtaagccgggcggaggacgcagttaaaaatgcgatgatgaagataaagggggcgtatgccctagtagtgagcagcccgcgcaagatgattggagccagggaccctctgggactgaagccgctgtgtattggaaaaagggataatacgtactttctggcctcggagagctgtgccattgcggcggtggacgcggagtttgtacgtgatgtacttcccggggagattgttacgattaccaaagaaggaatcgcgtccgatacgggcatggcagtaccggctgcgggacaggcccgctgcatttttgagtatatttattttgcgcggacagacagtactctggacggggtaaatgtctatcattccaggattaccgcaggcagggcattggcggaatcataccctgtggaggcggatctggtagttggcgtgccggattccgggctggttgcggcaaagggatattcggaacagtcgggcatcccctatgggatggccttccataagaacagctatgtgggaaggacgtttattaagccgagccagagcgaaagggaatccagcgtgaagatcaagctgaatgtcatacccgaggtggtaaaaggcaaaaggatcatcatggtggatgattcgattgtgcggggaacaacctgtgctaatattatcaggatgctgaaagcagcgggagccaccgaagtccatgtcagaatcagttcaccgccgttcttgtatccgtgctattttggaaccgatgtaccgtccaatgaacagcttatagcgcattcccatacgccggaacagattcggaagatgataggggcggattctttgggatacatggaggtcagtaagctgaaaaatatggtgggagatctgggctactgcgatgcatgttttaccggaaaatatccaatggaggtgccggacggggatatcagccaggcatttgagcaggggacctggtaggacgcctgcttttcgcttttatggatatgaagcagaaatccttggtttatacaattgccggggtattgacagtcatttagtatatataagaataggagattagatttatgagtacggaccgttatgtcagccctctttctgagcgttatgcgagtaaagagatgcagtatatattttcacctgataagaagttcagaacatggagaaggctttggattgccctggccgagacggaaaaggaactgggtctgaatatcacagatgagcagattgaggaattaaaggcccatgcggaagatatcaactatgatgtggctaaggaaagagaaaaggtcgtgcgccatgacgtgatgtctcatgtgtacgcctatggtgtacagtgccccaaggcaaaaggcattattcaccttggcgccacatcctgctatgtgggagataataccgatataatcgtaatggcggaggcactgaggctggtgaggacaaagctggtcaatgtgatcgcggaactttccaggtttgcagacgagtataaggcacagcctacgcttgcatttacccattttcagcctgcacagccttccacagtcggcaagagggcgacgctctggatgcaggagtttgaaatggatctggaggatttggattatgtccttggcagcctgaaactgctgggatccaagggaaccacaggaacccaggcaagctttctggagctctttgacggggatcaggagaccattgacaagatcgatcctatgatcgcggaaaagatgggattcggagcttgttatccggtatccgggcagacttattccagaaaagtggatacaagagttctgaatgtattggctggcattgccgccagcgcgcacaagttctcaaacgatatccgccttctgcagcacctgaaagaggtggaggaaccctttgagaagacccagatcggctcctctgctatggcatataaaagaaacccgatgagaagcgagaggattgcgtccctttccagatatgtaatgatagacgcattgaatccggctattacatcggcgacacagtggttcgaaagaacactggatgactctgccaataagcgtctgagcataccagaagggttcctggcaattgacggcattctggatctgtgtctgaacgtcgtcgacggactggttgtatacccaaaagtaattgaaaagcgtctgatgtcagagctgccatttatggccacagaaaacattatgatggatgccgtgaaggcgggcggagacagacaggaactacatgagcgcatccgcgagctatccatggaagcaggccggaatgtaaaggaaaaagggctggataataaccttcttgaactgatcgcacaggatgaagccttcaatatgagcttggaagatctgaaggagacgatggatccctcaaagtatgtagggcgggcaaaagaacaggtagagtcttaccttaaacatgtaataaggcctctgttggaggaaaataaagacattttgggcgtaaaagcagaaattaatgtttaggttttagatgggcgggggattttctcaaaggggacgctgaaaaaccgggaagcctgccccaggccgggcacatctatgccattttaaaaatccgttccgtttacgtaagcggccctaaaggaaaaaacatagcaaatggcggttcagcggcatgcaacccgaaatttgataatttcgggttttaggccgcttcagaatttgacgtgagacgtcaaattctgcccaccattttctatgttttttccttaagggcctctaacgtaaactataggacttttaaaatggcatagatgctcccggcctggggcaggcttcccggtttttcagctggtacatccggccgttaggaaaagctcgtccactgagcggggctccgagcggtggcagcgtattaattctttctggggctatgctgtcccccagcgaattaatacgctgccacggtctgagagccatcccggcgtacgagtccttcctgccggttggatgcatcagcgatatgaagggatcagcgaaagcctccccatccattcacaaggctaaagcttgttcatttagttttgaaggggtgtttttttatgtggtctgtgttatgatagatgaaagtgttattaatttaacatttggaaggagagcggagatgcgtttatttattaaacagagggtgttttcctgcactgattcttacgatgtatatgatgagggcggggaggcaaaatattttgtgaaggctgagttttttacgctgggccatcagattcatgtgtatgactggcggcagagggaagtcggcgccattcgtcagaagctgatgactctgatgccgcagtttgaaatcgaaatgaacggtatggtactgggagaaatccagaaaaagtttacatttttccgcccaagatatgaagtggattttaaggaatggcatgtggaaggcgattttctcggatgggaatatgatgtctgcgacggccgcggtccggtggtgcatatcactaaggagttcatgcattggggagatacctacgtgctcgactttgcaaatccggcggatgaacttacggggctgcttcttgttattgcaatagacgcggcgaactgtacgaatgggcagtaaggtacatgagagattatccggttacattccgtatggagaggatgcggccggatggtaacagtccgggcatgccggaactgttacgctggatgcgggaatagagtactgaattttagaaattttatagacgaaagtatgaaactgtcttataattggaaatagtaaattcagggataaataaaggaggccgtatttatggcaatatggattatattagcaattattgtgattttgattatttggcttgcaggctcttacaatgggtttattaagctgaggaacaagacagaggaagcattttctgcaatggatgtgtctttgaagaaaagatacgatctgattccaaactatgtggagacggtaaaaggatacgcaaagcatgagtcgcagactctggaaaaagtgatttccgcgcgtaatgcagcgatgaatgcatcaacggcggaggaacggattgcaaacgacaacattctaagcggcactttaaagtctttatttgcagtatctgaggcatatcctgatctgaaggcaaatcagaactttctgcagcttcaggaccagctgcagcggattgaggaggagattgccggttccagaagatattataatggcgtagtgaatcgttttaatacgaagacagagatgttcccgggcaatatcattgccggtatcttcgggtttcagagaaagcctctgtatgaagtgaatgacagcggtgagcgtgagaatgtgaaagtgactttctagcagggggatgccagtatgaagaaatttagcggaagaaccgccgctatcattatatgggctgttgtatgggtgttttttatgtttggttcagggattgtggaaaaagttgtaaaccctgaggtagaacgaaaagaagatctgaacatgactacgcaatattttaacacagacatcgaggtgggggagaaccagtcctataaagtgacagagcagatcggagttgactttctgacgccccggcatggcatctaccgttatattccggtgaagggaaccgtatatactaaagacggcgggaactttcagggggtgccttataatgcccggctgacagggctggaatctcgggaggaaacagaagttgattctgaaagcggatctaaggtaatccgttttggttcggaggatgcatatctgaccggacggaaagaataccggttttcctatacggtgacaccgcgtttccaggagaatgcgtatcagaacgcctattataacgtgtttccgactcagtggcagaacaggatccctgctggaagcagatttaccatcacatttccgaaagaatttcctcacgatattctggagttttattacggaacctatggggagaataagaacgctgcagcaattctggatctatcctggcagggaaatacggtcacgggcattttgaaaaaagatttaaaactgggggagggaattacgttctttgcgcccatggaagctggttatttcacaggtgtcgggcagcttactttcctgccatggctgctgttattgccggccgtgatacttttgctgctgattgtttttctttttgtgagattcggaagggatgaaccgattattccttcgattcagtatcagcctccggataatctggacagtgccgccgtggggtatattattgacggcagtgtagaagataaagacttgctttccctgattatatactgggcggacaaaggctttctgagcattaaagaaatgccggaccatgggctcagtctgttcaagctgaaggaacttcctgaggaagcgcccagctatcagttctgcatttttaataagctgtttgagtacagagaaatccgtaaaatcagtgacctccagtataagttttcaggcacgctggagatggcgaaaaaacagctgaagaattattttcaaaagcagggccgggatatgatatataccagagaatctaaaattgccaggacagcggcgattgtatgctgtacgctgcctttggcctggtttatggtgctcacaagtatctattcttatacaagcggcggcaggatctttgtccaggtgctgctgtgggttatgctgctggttggcacactggttttctgcagtgatattgatacatggtatgccagaaccgatacatcccgcaaactgacggcgggaggcacactggcggtctgctttttatctaccgcagtgtatgcgggcagttatgttatgcgtgtattccaatatgaagtctttaattatatatgggtgctggttcctgttctggcggccaccggagtgatgatcgggctggcaggatttatgaagagacggacatcccagtgtattgaatggatgggaagacttgccgggcttcgtgattttatagaaacggctgaactggagcgcatgaatgaacttgcaaaaacgaaccctgagtggttctatcatattattccttatgcttatgtgtttggtctttccgacgtttttgctaaaaaactgaaaggcctctcagtaccggctcctgaatggttctctccatatcacagctattcttttttcgattactatatgtttaacagactcatgatgagcagcctgaataaaactgcatccacgctgaccgtatccagaccagtgcagtcaggaggttccggaggcagttttggcggcggaggctttggcggcggcggtttttccggcggcggtttcggcggcggaggaggaggcagctggtaatattaagaaaatgcaaaggaatgttgcgaaagattgcggcgttcctttttcttatgttaaatttatatttgtgtgagtattatttgtggtatggaaagaaaggtgcaggtaaactgaaaatggaatgttgtattagaatttttgagagcggtgttgcgcgaagaaggggatcgcgcatcatagggatagtgatgataattatgctggcggcagggcttgtctgtgaactccctgctttggaatttacggagtcggacgccgcatatcgaatgatttacggaaaatattatggaaaagagctggtgacatatgggacaaacagtgagggagccggcgccttagatattttcggcaatgcggtgaatcgaataccggtaaagacaaatattaataaaatgttgaaagaaaacaaaagagtgaagtcgatgacagagcagccggaagcggaacaggcagacttgctttcggacttctttttgatgggcatagaaataccggctattggtggaatatcagagacagaggttccaaatctcaatttcacgggagtgcatatcccggaatcaccgacaggaaatgtgaccccgccggtgattccggatattcctgcagccaatgataaaccctcagttccggatgcacccatcacaccggataatccgatcgtacccgatctgccaattgtgccggatacgccgcttgttccggataatccaccggtggatgttgacccggcagttccgccggatgtggtcgttccggatactccggatgtggaagcacccgacattccgggagagaatgatgatccaaacaacggtacggatgaaccggcgattgaacagccggcaggctttacggtaaatgcggatggtatgatctgtgcttacgatccctctgcgggtatcgtaaaggaaggccgtcttgtgcttcccgcagaaggctgttcaggaattgcaagggggacctttgaaggggtcggcgcggagatctatgaactttttattcccccgaatattgtaaatatcgaaccaggtgttctgagtgaactgacggaccttggctggattcagctgacggaacccaatgcaaattatacatggcaggacggtatgctgtttgacagcagcatgacaacacttcttgcattcccgcgtggaagaatcggtacatatgcgcttccgtctaatgtgacaaggctggaagattattcgtttttaaacaccaatctgaccaagatagatatgatgaaatgtggtgctgtagaagtgggcagcaatgtgtttggcgggaatggcggaaatggaattacgattatggcgccaagggagcacctggagcattaccagaatgtatttgcagagttgggtgtgacaatacgttaaaaagagatttcctctgaggacttttcgtaacaggtaacagtttaggaccgcctgaaattttccgcggaaaaggtgtatttattcaaaaaatgtgttaaaatgtgtaaggatttgtgcagactatatgtgacagagaagcaagaatcagtatgcccggcacacccgggacaaaggcgggaaaatggatggattataagcttgtgatgaatacggcggtactggccggcgagatgatgctgcgcagcggggcggagacgtacagggtggaggataccatcaaccatattctgcacacggctgatacagagacggttgaggccagtgtgatgatgaccggcattgtggccacaattggcaacccggatatggagccgattacggtgattaaaagagtacagaaacggggaacaaatctgaaccggattatgagggtgaatgaaatatcaagaaaatactgtgcgggagagctgactctggaaacggcttataatgagctgaagagcatcggtggaaagcagtaccctgtctggatttataatctggcaacggtgctcgtccccgcgggatttgccccgctgtttgggggcggtattctggaaactgccgctgctgcgttcgtgggtgctgtgcttgcattggtggtgactgtgggaaaacgcctgcagatcaatggttttatactggatacgctgtcctcctttggactggctgttgcggctgcgtttttgaaaaggttctgcccggggctggatgaggatattgtcattatcagcgcgattatgccaatggtgcctggggttgcgattacaaatgcggtgagggataccctgcagggggattacatttccggcggagccaggatactggaggcatttctcaaggcagcggctgtagcgctgggagtaggggcggcaatggctctgacggggctgatgtatccgggaggtggcaatttatgaagctgatatttggagtcataggttcctttgtggctgtggcaggctttgccgtactgctggagacgccgcgcagatatctgctccatgcgggaatcgccggggcgatcggaggttttgtgtacctgttcagcatccagcgaggggcggatgtggttctgtcctcatttttttctgcgctggcgattgcgcttacatcgcatacctttgcacgggtgtttaaggcgccggttacgatcttcctgattgcaggaatcctgccgacggtacccggggcggggatgtaccggattgtgtattatatcatagccaacgacagcgcaaaaagcagttattatctgatccagacacttgagattgccggtgtcatagcccttgctatctttatcatggacaccgtgtttaaagtgcggtttaagaaagtataaaaataccaaaattcgccttttttgtttgttgaacaatacagggacttgttttataatgaaattaacaacataacctgcaacagactgttcatgctagaggaaagggcgggatgaatatgcgtagtaagaacattttgcaactactggaagaaagcaagtataccgtagcgataagtggaaaagagatgtttcttgagaatggttaccccggagtacgtgatggagaagagtcttacgagattgaacaaaagtatgggtattctgccgaggagattttgagcagtgctttttatgcgacaaggaaagaagttttctttgagttttacagaaccgagatgcttgcagctgcagcgattgcgcctggaaagggctttttaaatctgcaaaagatggaggaatacggccttgtacactgcgagattacaaaaaggctgtttggacttcttgaaagagccggatgcaggaatgtgattaatcttcatggaagtatctatgataatttctgtccccattgcgggaaaaaatatcccattgagtacattatacagtcaaaaggcgtgcccttgtgcgaggactgcaagaacacgatacgccctaagatctgcctttatggagagatggtggataatgggattgttacaaaagcagcggaggagatccagaaagcagatgtactgcttgtgcttggaacaagcctccatgcgtcgctctgtcatcagctgatccagtactataatggtgataagctgatcctgattacgaacgaagagcattattctgataagcttgcagacgtgctggtctacagcagagtggatgatgcccttgaaaaactggtaacagcataccagaacaaatggaataaagaacatgaattggagaagagagaacatgagtaaagtaagaacaagatttgcacccagcccgacaggcaggatgcatgtaggaaacctgcggacagcattgtatgcttatttgatcgcaaaacacgaaggcggcgactttattctccgtgtggaggatacggatcaggagcgctttgtggaaggcgctctggatatcatataccgtaccctggagaaaacaggcctgattcatgacgaggggccggataaggacggtggattcggaccttatgtgcagagcgagaggaatgcctccgggctgtacctgaagtatgcaaaacagctggttgagcagggggacgcttactattgcttttgcgataaagaaaggctggaatctctcaaaacatccgtgtcggaggatggaacagacattgtcgtatatgacaagcactgtctgggactttccaaagaggaggcagaggcaaacatggctgcgggcatgccgtgggttatccgtctgaatgtacccaacgaagggacaacgacttttcacgatgagatatatggggatattacggtgccgaataacgaactggacgatatgattctgatcaaatctgatggttttccaacgtacaattttgcaaacgttgttgatgatcatctgatggaaattacgcatgttgtcaggggaaatgaatacctctcctccgctcccaaatataaccggctttatgaggctttcggatgggatgtaccggtttatgtgcactgcccgctgattaccgatgagaaccacaagaaactgagcaaacgctgcggacattcttcctatgaagacctgatcgagcagggcttcgtgtcagaagccgttgtaaactttgtggcgctgctgggctggagtccggccgacacacaggagattttttccctggaaggcctggtggaggcttttgattaccgcaggatgaataaatcaccggcggtttttgatccggtaaagttaagatggatgaacggagaatatttaaaagccatggattttgatacattttatgagatggcagaaccctatctcagagaatgtattacaaaagattacgatctgaagaagattgcatcactgatcaagacaaggatcgagatattcccggatatccgtgaacaggtagacttttttgaagagcttccggattatgatacagcaatgtttacgcataagaagatgaagacgaatgaagagtcctctctggaagtacttaccgagctgcttccgctgctggaaaaacaggaagattacagtaatgatgcgctgtttgagacgctaaagggctatgtggcagagaaaggctgtaagaacggttatgtgatgtggccggtgagaaccgctgtctcaggaaagcagaatacaccggggggcgccaccgagatcatggagatcatcggaaaagaagagtctctcagacgaattagaattgcagttgaaaagttaagctgacggttcacatttctgaacgtcagtaagtagaaagaggtacgtatgagttttagtaaggctcagtcagatgcagtcactcatggggtgggcccatgtcttgtccttgcaggtcccggatccgggaagaccctgacgattgtaaaccgaatgaaatacctgattgaggagcgaaaagtaaggccagaagaaattctggtcattacttttactaagtatgcagcagcagagatgaagtcccgttttcaacagctgatgggaaataaaggcctgccggtaaccgtggggaccttccacgggatctattatggtattctgaaatgggcatatcatttcggccctcagaatattctctcagaggaagaaaagtatcagatcgtgaggcaggctgtgaacaggcaggatatcgagatctttgatgaggaagatttcctgcaggatatcgtgactgagatcggtattgtgaaaaataacagaatggacatagatgaatacagatccgaaaagtgcgcgccggatgctttcagaaacatttaccgggaatacgagacacagcggaaaatcgcaaagaaaatcgattttgacgatatgcttgtactgtgttatgaattgttccggtccaggccggatatcctgaagctttggcaggaaaagtttcattatatattgattgatgaatttcaggacatcaatcagatccagtatgatgtaattaagatgctggcggaaccacagagtaatctgtttgccgtgggggatgatgatcagtcgatatacgggtttcgaggggctgattcacggctgatgttccggttcacagaggactatccggaggcgaaacagctgctgctggatatcaattaccggtccacttccaatattgtggagaatgccctgaaggtgatcggtcacaatgagatccggtttcagaagaaaatacgagcacagaaaccccggggagcaagcctgcacgtgcaggaggtgcgggatccggcggaggagggaggatatgtgctggaagagatccgggaacggatccgcgaaggcgtacggccggaagacattgcggtactgttccggatccatacggatgcccggcctctcgtggagcagctgatagaacacaaaatatcttttcagatgaaggaacatatgccaaacatttacagccactttatagcaaaagatattatggcatatttccggatggcatcggggagccgtgcccgccaggattttctgcagattatgaaccgccccaagcggtatatttccagagaaagcttatccggcagggaggcatcttttgaggatttgagaaagttttactgtgacaaggaatggatgcaggacagaatagaccagttcgaatgggatctgaaaatgctggctaagatggccccttatgctgccttccagtatttgagaaaaaggatcggatacgatgattttctgcgggaatacgcttcatccagaagaatgcaggcaggggatttattcgaggtgttggtagaattggaggaggcggctaagccttttgcatctatgaaggaatggtttgagcatgtggaggagtataccagtgcgctgaaaatgcgggagagcagcagggaaagacagcaggagggcgtccggctgatgacgatgcatgctgcaaagggcctggagtttgatacggtttatatcatcgaggcgaatgaagggcagattccttataaaaaagctttgaaggaacaggggacggaagaagaacgcaggctgttttatgtggccatgaccagggcaaaagagcagctgaaaatcatatatgtaaagaaaaaaaacggaaaggatgtttcaccttcccgttttgtcgaggaacttcttgaggatgcaaagaattaatcctcgtccgaatccaagtcttcatccaggtccaaatcttcaaattcctgggaatccagccattcatcaaacttatctgcagcacgttcatactcatcgtcgtcttcaatgttttctagttcaggctgtccttctactggttctgagaagcggtagagataaacctgtccttcgtcattgctgccttcctcgtcgagcggaagcagggcaatgtattcctggccttccacctcataaatcgtgaggacggcacactccagctcttcgtcattatcgagtgtcagtgttacagtaagtgattcattttcgctcataaatggtctccttttttcattgataacttaactctaacaaaaagaaggctaaaaagcaagggaaaaacatgagccggttcctattgtgactgtgtccgttactatttacggcccaggggccgcgcatagtaacggtatctgggccatttaaagtcgcctagggcgagggcccagatgcccggctccatcactttaatggctcagatgccgtgcagcgggggcacggccccgtgaatagtaacctgcggcacactgcatcgtttacggcacggtgtgatcagtaacttcctattgacattggggagaaacacgatagaatggaagaaggttcttaaattttgctgaacaggagggtattgaatgaaaagaaagttactgagcgtattactcattgtcctgatggtgtgtttgctgctggcaggatgtaaaaagaatgtgggtacgcctgaagataatgcagtacaggatacagagacagaagaaggagaggacgaggagcaggaggagactggctatacatttggctatagctgcattgatatggggaacccctattttgacaccttaaagatgtcgattgaaaccgcgctgtccgaacaggagtatcacctgacagtcaaggatcccggcacagatgtgaatgttcagattgagcagattcaggaaatgattgagcagggtgtagatgcggtctttttgtgcccggtagactgggaaaagatcacgccggctttggaagcgctgaaagaggctgatataccggtgattaatatagctacacaggtaaaggatacagatttgattgacgcttatgtaggttcagataataaaaatgccggttttctgtgcggtgaggatttgatgaagcagcgtccggacggaggcaggattgtcattctggagtgtccgtccatgaattcaattaatgagagaataacaggcttcgaggaggcgattgccaacggcggttttgaggtgctggcaagagcggatgttcagggaaaaaaggagaatgccaaaagtgaaatgaagcgcatactgtctgagaaaccggagattgacgctgtcatgtgcggaaatgaccaggtggcgctcggggtgctggaggccgtggaagaagcgggcagaaaagatatcctgatatatggggtagacggctcgccgggagtgaagagtgaactctcgaaagcaggtacttccattgcaggaaccggagcacagtcgcccatcaatatcggcaaaaaagccgtggaaacgggaattgccatcctggaaggcaatgattatgaaaaagaaatttatgaggaaacattttttataaataaggataacgtagagatgtatggaactgacggctggcagtaacagcaggaagagaggaccttagattgtgaaaaaagtacagggaagcccgcagccattaggcgtgacaatcggaaccgaaagaatgaattttgccgtttccgtatccccggggaagttatgtgagctgctgctgtaccgggccggcagtgcggacgttgagacagtatatcccatgcaggaagaccctgcgatgggggaggtacgctttcttgcactggaagggctcaatccgcaggaatatgagtacaattaccggatcggggggaaggtaactctggatccatatgtgaggcgcataaccggccacctcgactttggccagaaagaagatctggagtcgcataaagtgcggggcgtctttctgacggagaacttcgaatgggaagaggacagaaggccctgcatcccttatcatgaagtcatcgcctacagtctccatatccgtggatttaccatgcacagctcttcaaaggtaaagcataaggggacttatatgggggtgatggaaaagcttccatatctgcaggaacttggaatcaaccaggtgcagtgcatgcccgtctacgagtttgaagagtatgcgggaaaacgaactaattactggggctatggccggggctgctattttgcgcccaaggcggcctacagtgccgcgggagatgctgccgcagagttaaaagaaatggtaaaagccttccataaagcgggaatagaggttatccttgagatgccttttgaggagggaattctgtatcagaccgctctggaatgcctgcattactatatgctggaataccatgtagacgggtttgtggtcaatccctatcatgtatcatgggacgggcttatggctgatcctcttttaaagggtgtcaagattctgaaaaaggaagagtggttccagaatgtgatgcgccggttcctgaagggggacgagggtatgatagacgatgtgatatgggcgcttcgccgcaacacaaaagaggacggctgctgcaactatataaccacgcacaccggattcactctggcggatcttgtatcctatgatgagaagcacaatgaggctaacggtgaacataaccacgatggccccgcctataattacagctggaactgcggagcagagggacccagcagaaaacgctccattatggagcttcgcaaaaatcagataaaaaatgcattctttctcctactgacagcccaggggactccctgtctgctagcaggcgatgaatttgaaaatacccagaagggaaataacaatgtatactgccaggacaatgaactatcctggctgaattggaatagactaaagaataatgattccttattccagtatgtaaaagcgttgattgctcttagaagggaacatcctgtgctgcacaggccggatgcgctgctggggctggatcagatctcgtgcggtactccggatgtatcttatcacggagaaaatgcatggcaggtaccggcagatgtctcaagcagacagctgggggtcttgtactgcgcaagcgggcagaacgacaatgattgttttattgcctacaatatgcattgggttaaacatacatttgccctgccggcactgccaaagaaaaagaagtggtaccgggttatggacacggcagagggaatactggaaaagccgcagcttctggaaaaccagaagacgatggtattaaaagaaagaagcatcttgcttctgatcggcaaataaataccggctggcaggaagacaggaaggacgttaaagcggtatgaaagcaatacggcatttttgtacaataaccagacataaactattggtcatgaaggaatgctttcgggtgggcctgtactggcaggggcttctgcatgacctttccaaatacagctggacagaattcagcgtaggctgcagatactaccagggaaacagaagccccaacaatgcagagcgggaggcaaagggactgtccaaggcatggctgcatcataaaggccggaataagcatcattatgaatattggattgattatggaataaacggagaaaaagatatgacaggcatgaaaatgccggtccgctatgtagtagaaatgtttctggaccgcatcgcggcctgcaggatatacaaaggcaaagcttataagaagaccgatccccttgagtactttatggcggggaagggacattatctgatgcataaagaaactgaggcgctgctggaaaaactgttggtgatgctcgcagagaaaggtgaagagccgacctatcagtatatccgtgaggaagtgctttgcagaaataaccgctttacaaaatcatgccgggagtagagaaagaagaacataaataaagtgtaacaaaaagaacgacaaaaagccagcatataaacacagagggcagggaagtgcaagcagactacaattgtacggaatgccttcaccacaggacgtagaggctgtggaaagtttatttgctggctgttatggtttgagtgatatttattgtgcatgtttttctgaagacgtcaagtggaatctaaatttattccggataatacatttgataatcctgtatgtcgataagtacattctgcagatattttttcgctacatatttcgccataggaagattcatgtccagataattgccgcagtccttggctgctgcgcctggcacttctccttcaaatgcagatatataactaaacatatccctgataagcccaacgatatcttccggctgatattgtcctgccagaagcagataaaatccggtccggcatcccatcggcccgaagtaaagcactttgtctttaaaatcaggatggttcctcagaaaggtagcgccgatgtgctccaatgtatgaacttcggcggtattcataactggttcatcgtttgggctggtcatacggatatcaaaagtagtaataggatttccgtttacctcatctcttctggaaacataaaggcccggaaccaattttaaatggtctattgaaaaacttgcaattttttccataataatctcctttttgtatacccaggggcaacccacaacccatgtactgcgggcggatccacatgcaagggattggtgacagaattccctggggtattaagttaatttgatttcaccaactattataaaggtatctggcaaataagacaagaagtaaaagttgacgaaagaaaaagtaatgattatactaaataagcagagaaatatgatttacgaaaaagtatcctgtaaaatatgtttattcataaaaattatatatcagggaggcagataatgaagttatatcttgttcgccatggcgaaacagcatggaataaattaaaaaaagttcagggacactccgatatttcgttgaatgcgtatggaagatacctggcggaagagacggcaaaggggctgggggatattccgtttgcggccgcatatacgagtcctttgtccagggcaaaggaaacagcgcaactaattctggcagggagaaatatccctttatatgaggatatccgaatccaggaaatgggatttggcgtagcagagggaatgtgctgcaggggcgagaacaaagagccaggcagcgatgagtttaacaaactttttactgacacgaagaactatatagtgcctgaaggaggggaatcgatcggacaactggaagacaggatccaggactttcttcatgagctgtatgacagaaaagagtatgaggataaaacacttttaatttccacgcatggagccgccctcacagcaatgctgaatcttataaaaggacagaaggatattgcaagattttgggaaaacggagtacctgcgaattgttcagttactgaagttacagtacagaatggaagagcggaaatcattgaggaaggacgggtgtattattagaaaaaggccagtcgagaaccggagggcagagaaatgctagtacctcgaataattttatcttagcttaagagtcagttacttgatttacaatgcaccagtcagccggagtaattaaaaagaaggactgcacaggcagcctggacacaccagccgaagccggaaggctgcgcgttctgggaccaggaacaggtataatccggattatacttttgcctttgctgtcctccttttgcgttgtaatatctttctatgaaaacgataccgcacaagccgccccgcgttttgtgaacgcattctgctcctcgaaaagaaacccacctaacacctgtcaaaacacataattggaaaaatataccagcatgaggcggtgtataaatatgcgataatagttgtgtcgtaaaaggagggaaaataatgcacaaaagctttggttatgttagggtatcttcaaaagaccagaatgtagaacgacagttggttgcaatggaatccctgaaaataccggaaaaaaatctttacattgaaaaaatatccggaaaagactttgacaggcccgagtataaaagacttttgaaaaacctgaaagaggaggacgtgctctatgtaaagtcaattgaccgcctgggcagaaactatgaggatattattgagcagtggagatacataacaaaggagataggcgcggatattgtggtgattgatatgccgcttctggataccagaaaaggaaaagatctggtgggaacactgattgccgatattgtactgcagctgttgtcatttgttgcacagagcgagcgtgaaagtatccgccagaggcaggctgaaggcatcgcagtagcaaaggctcggggagttcgttttggcagacgcagcctgaagataccaaaagcatttgaaaaaatctattggcagtggaagcgcaatgaaatcagcgccagagaggcctcaagaaggctgaatgtggattttaaaacttttaagaagtggtgcagccagaaagatgggatgtaaaaataaggcaaataatgcagaaaaaggtagactttattctgcattattggtaaaatagtattagttggatgcatcttgtgaagaaaaaggtagactttggtctgcaagtgcattacataactttttagatcgtaaaaggtgactttttataggaaaatgactaaattttccatatatattttgtgatttctgttttaatttatattatcaataatgcagaataaagtctgctttaatccgcagtgccgtaaggaggaatgaactatgacaagagaagaggggctgttagaatttttggcgcatcaggtaggtgccagctatatttctgatttgcggaaagatgattttcacagggagctgatcaattgtatagaaaaaattaagagtactgactatccaataaatgaatgggtagatgttttagactatctgacaggaattaaaagaagaatagaaagccccgaagaaggtaaagaagctttactcgaagtgttatgaacagcgtaaagaatgtaaaacaggtatccataaatcccggataggattgcggatacctgttttatcatttgggaatagaataacagatccatacattctgccacttgacatgtggcactcgaaggagtattattcaaaatgaactatgttcagtttcgcataggaggtgttctaaatgaacttgacggctacatcagaagaggcaattatcgaagcctgtcagagaattgtgaaagaaaaaggactatcagccgtcaatatgcgttctgttgctgcagagtgtaatgtagcggtcggctcgatctataattactttccgtccaaatcggatttgctatgtgcggcaatagaaagtatttggaaggacatcttttatatatcgggcagcaatcccgggtttgtatgttttgcggactgcctttcatggatgtatgagagcatgaaagaaggtggacggaaatatccagagtttttttccatgcatgcgttaagttttgcatcagaggataaagtgaggggacgcagaaggatggaggaatatttcacccaattaaaggaaagccttctggaaatattaaagaaagactccagagtgagggaaggggcgtttaatgaaagcctgacgccggaactgtttacagactatatccttatgatctttttttcatcactgacagatactcagcaaaatagcgcaggactgctggagatcgtgaagagatgcctttattaacccattgtctggaataaactgcagacctatccggcggagttaacgtgccggtacacatagacttacacatacccaaagggcaccccgtaactcatgccctgcgggcgggtctgcagctttgctgcagaataaagtatacccactttcagagtgggaaaatttttatccaaaatgaacggtgttcagatattttcggaggttcatcatgaaagtaaaaaaagaaaatttattgataatagcaagtctcgtatggcttgcggcgggattcaatattcttcgtataggaatcaaatcctattcaggatatgttacgattttaaacctgctcctttctgccgtcgtttttcttatattctggtttatggtcttttataaattaacagtgaaacataccgacaggatacagaaatacgaggaggaactacagttctttttaaagttttttgacatcaaatcattttgcatcatggcctttatgatgatattcgggatatcaatccgttcatttaaccttgcgccggatgtatttatcgctgttttttatacaggactcggcaccgccctgttcggggccggccttttgttcggccgcaactactataagtataaacagcattaagaagccatgaaaaaagttttgtatcattcaaccggaggtttatatgtctaaattactgatcgcagcgattatttttatgaccctggcgcttacattctatacaatcggggtatttggcgaaaagaaaaaaggagtattgatgaaatggcacgtcttagtattttggatgggctttatctgcgataccacaggaactacaatcatgggaaaaatatcaggttccggcttttcattcaacctgcatgggataacaggcctgattgcccttcttttaatggcatttcatgccgtctgggcggcattcatacttgcaaaaaacaatgaaaaagccaagagagttttccataagttcagtatcatagtctggtcaatctggctgatcccatatatactaggaatgatcatcggaatgcagggataaaacaaccgtccacatacaactgtccccgttcacctaatttcttaacccaacccaatccgccgcttccgccgccaatttccccaaaaagcggacatcttacaatcctgatgcgcccagcctatctgagacggagagaggcatccctctccccgtttcagataggcgtcccatcatcatacattaaaattcccgctcaataaaattttaatcatcctcttctgtagcgacgctgtatgtctgccgttttctagccatctcatcgttctcgaggtactcatcataggtcgtgatcttatcgatcagtttaccgcccggtacgatttccatgatccgattggcggttgtctgcacaatctgatggtcacgggatgtgaaaagcagaactcccgggaatttaatcatcccgttgttgagtgcggtgattgcctccatatccaggtggttggttggctcatctaagagcaggacgttggcgccggatatcatcatcttggacagcaggcagcgaaccttctcaccaccggaaaggacccttaggcgcttcacgccgtcctcaccggcaaagagcattctgccgaggaacccgcggacataggtcacatctttgttctcggaatactgagtaagccattcggtgatggtatagtcattatcaaactccccgccgaagtctttgggaaaatatgcctgtgaggtagtgattccccatttatatgttccctcgtccggctccatttccccgatcaggatcttaaacaataccgttttggcttgttcgttgctgcccacaaaggcaaccttgtcatcgtgtccaagcgtaaaggtaaggttatccagtattttttctccatcaatggtcttggaaagtccctctacagaaagcacctcgtttccgatctcacggtcaggacggaaatcgatgtatggatattttctgctggatggtttgatctcatccagttcgatcttctccaaagccctcttacgcgaggttgcctgcttggacttggaagcgttcgcgctgaaccgggaaataaaatcctgcagttccttgatcttttcttcctttttcttgttggcctccttcatctggcggatcagcagctggctggattcataccagaaatcatagttgccggcgtatagctgaatcttgccgtagtcaatatcggctatctgcgtacataccttattcaaaaagtaacggtcatgagaaacgacgatgaccgtgttgtcaaagttgatcaggaactcttccagccatgcgatcgcatccaggtccagatggttggtaggctcgtccagaagcaggatatccgggttgccgaataatgcctgggcaagaagtactttaaccttttctgcaccagtcagatctttcagatatttgtaatggagttcggtgtcgatgccgaggccgttcaggagggtggctgcgtctgattctgcctcccagccgttcatggttgcaaattccgcctccagttcacttgcccggattccgtcctcatccgtaaaatcttcttttgcatagatgacttccttttctttcataatttcatacaaacgcgcattccccataattacggtgtcaagcacaataaactcgtcgtatttgtaatgatcctgctgcagaaaggaaagacgttcacccggtgtgatattgacctcgcctttggtaggttccagctgaccggataaaatctttagaaacgtagattttcccgcgccgttggcaccaatcataccgtagcagtttccttctgtaaatttgatattgacatcttcaaacagcgcttttttaccaacgcgcaaggttacattatttgcactgatcatagcataatctcctttatattcatgttcctgtaatcccaacgcttatattaacatgagatggatggaaatggcaaggtttcgggcggttttcacgaaaattaaaagtttgttgttttcgaatagagaaaatcgttatataatgagaaaagaaagcgaggagaatttatgcagaaagcaacattagttttggaaggcggagcaacacgcggagtattttcatcgggagtcctggattatctgatggagcaggagctgtatatgtcacatgtgatcggagtttcggccggggcatgcaatgcagtggactatgtttccaagcagccgggcagaaccagggactgcatgatacctacagataaaagcggcagttattattatggtttcaggaagtttgtcaaagagcgcagcctgatgaacatggatttgatttttgacattttcccgaatcagatctatccgtttgactatgagacttattttcagtccgagatagagtgcgaactggtggcgaccaactgtctgactggaaaagcggagtatttcaaagagaaaagcgaaaaagagaggctcatgaagatttgccgtgcgtcttcaagcatgcccttggtgacgccgattgtaaagatagacgacgtcccctatctggacggagggcttgcggacagtgtgccgttgaagcatgcaatggaactgggcaatgacaaggtcgtggtcatcctgaccaggaatgcgggctacagaaagaagaaaatatcttccgggctggcagaggtataccgaagagcctacagatcctatccgaacctggtaaaggcaatattgaccagaagtttttactataaccgtaccatgaaccatctggagacactggagagacaggggaagatatttgtgctgcgtccgcttgtgaagccggtagccaggatggaacgaaacacggagacgctgaccgcgttttatgaccatggatatcagctgatggaacaggaatacggcaggctgatggaatatcttacaaaataatacacagcaaagcagcattgccggtacatcgaaatcatgtactgccacttaagcagactgttaaaagaaaaggaggccggaatatgaatttgtttgaacatcacatttctacaaagaatgcacagcagatgacaaaggtaaccaatatggtgcgtgaggatgtggccaggagcggagtgaaggatggaattatagttgtatattctccgcatacgacagcaggatttacgatcaatgagaatgcagaccccgatgttgtgcacgatatgcttgccggattcgaggaagtattccctctggaagcgcctttttaccgccatgcggaggggaattcccatgcgcatatgaagacagccgtgacaggggcgtcacagacattgattctgaatgacggggagattctgcttggaatttggcaggatttgtacttctgtgaatacgatggccccagaaaccgtactttttttgtgaaaattatggaaggatgagggccggcaggtctgcagttttaacagggatttaacaatattttatgtaaacaggatggaaaggcacctcaatgcatgctaagatcatcatgggatttcaggtatttatgccggaaagcggatgcccgttgggaatccggcagcgcgcttcaataaatgagcggctgcccagtgccttaaggatattactgtgaaagatgaggaagagagtatgagcagaaagacattagactatacacaaaacagagagctgtcctggctgcgttttaaccagcgggtgctggaggaggcgcgtgatgatagtgtgcctcttttagagcggatgaagtttgtcgcaatttttacgagcaatctggacgaattttttatgattcgtgtcggaagcctgtatgatatggcctctgttgataacaagaccgtagacagcaaatccggcatgacagcggaggaacagctggacgccatatatgcggctgtggcgccgctgtataaagagcgggataaaacctatgcggatattaaaaagcagctccatccgtacggcgtgtgcggtctggactttaaggagctggatccccaggaaaagaaatacgtaaagaaacacttcaaagagcaagtgcttcccgtcctgtctccgcagattgtggatgcaaaccacccgttccctcatttgctgaataaagagatctatgtggtggcggatctgaaaatggataataaaagtatgatggggatcgtgcccgtgccgcagttcatctccgatatcctgtatctgcccggacatgatatcagatatatccggatggagaaggtaattatggaatatctggatctggtatttgagcagtatcaggtatcagaaaaaaactatatctgtgtaacgcgcaatgcagatatttcaccggatgatgaggcttttgcggataacgaagattttcgttttatcatgaaggaaacgctgcataaaaggaaaagaatggcggttgtgcgcttggaaactgcagatcctcttacaaaagagatggaaaagtatttttgtgacaagtttaatataaccccatcctgtgttttccgaacaaagatgcctatgaagctggattatatgtttgcaattgcagaaaaggttccggtttccatgaggaggtcgctgattgacgagccgttttcaccgcagccgtccccttccgtatcagagggcagcgtattggcccaggtgaagaagcgtgatattttgctttccttcccctatgagtccatggagccgtttctccagatgatcaaagaagcatccgtggatcctaatgtcatgacaataaagattaccatttaccggctggctaagaaaacccgtctcgtggaatatctttgtgcggcggccgagaatgggaaagaggtaacggctctgattgaactcagagcacggtttgacgagcagaataacatcgactggtccgaacggatggaggaggccggatgccgtgttatttacggttttgaaggctacaaggttcattccaaaatctgcctgattacttacaggaataagaacgagatcaaatacattacccagattggaaccggcaattataacgagaagaccgcaaagatgtacacagactatactttgcttacatccagccagtctatcggggaggatgcggcggtattttttaagaatatgtccatagggaacctggacggcgcctatcagcacctgattgtgtcgccgaccagcctgaagccaaaggtgctgatgctgatggatgaggagatccaaaaaggcactgaaggcaggattattatgaagatgaattccgtaacggatatgaattttataaataaagcggcggaagcctccagggcgggggttaagattgatctgctcgtgcgcggaatctgctgtatccttccgggaattccgggggagacggagaacctcacagtgaccagcattgtgggaagatttctggaacatccacgggtgtttgtgtttggaagcggtgcttcgcagaaggtatatattggctctgcggatatgatgacccgcaatacggaaaagcgggtggaggttgcctgcccgatctatgacgaggccattaggcggcgtctggtccggggcctgaatatcatgctggctgataatgtaaaagcaagagtgatgcaaagcgacggaacctataaaaagaaagagcagacagagaaaagaatcagcgcccaggaggtatttatgaaagaagcgctgcatactaagcgccatgaaaaaccggtcgaaaagccatcattcctgcggcgtcttagaaaattatttcgctgagaacggaggaggcagaagatgggaacactgacagaaacagaatttggaacagcggggaatggacagaccgcatttttgtatacgttaacaaataagaacgggatgaccatatccgtgacggattacggggctgcacttgtggaactgatcgttttggacaaagaggacagaccggtggatgtagtactggggtatgatgacgccgctgcatatgaggctggcggtgcatccttcggtgcaccggttggcagaaatgcgaaccgcatcggcggggcctgctttgaactgaacgggattacctatccgctggagaaaaatgacaataacaataacctgcacagcggaacggcttactataataaaaggttctgggaagtggaggaaaagtccggggacagtattacatttgtcctttacagcccggacggcgaccagggataccccggagcgctcgatatgcgggtgacttatgaactgacccaggataataccctgcgcatgaaataccatgcagttccggatcgggatacagtcatcaatatgaccaatcacagttatttcaatctgaacggccatggcagcggtaatgtgctgaagcaccggctgacggtagatgcggattattttacaagggcggacgccgagtctattccaacgggagaactgacggctgtagacgatacgccgatggattttagaaaaccaaaggaaatcggcagcgggatcgatgtggactacgaggcaacacgccttggccaggggtatgaccacaactgggtattgaaaaataatggaaaatttgctaaagtagcggaagcggccggtgacgtgagcggaattattatggaggtgtggacagacctgcctggtatgcagatctatacatccaattttctggaccaggaaccgggaaagaagcaggcagtgtatccaaggcgtgcggcagtctgcttcgaaacacagtatttcccggatgccgtacatcatgacaacttcgagagcccggtatgcagggcaggggagacctactccaccatgacggcataccattttacagtaaagtaatatattttgtaacagttcaagccgatctgaactgttactgtattttactcccagggcagcggcggcagcaggttttcctgttccggtggttcagcatttggggagaatatagagaaaagcaggcagtataagtatttatggggaaatcagtatacatagcggagaagccgagtgtggcccaggaattcgcaaaggcattaaaattgaatacaagacgaaaagacggttatctggaatcggacgaggcgattgtgacatggtgcgtcgggcacctggtcacgatgagctatccggaggagtacgaccctgcgctgaagcgctggagcctgaatacccttccgtttattccgaaagaatttaaatacgaggtcattccctcggtggccaaacagtttcagattgtgagcgggcttcttacaagagcggatgtagacacgatctatgtgtgcaccgactccggaagggaaggggaatacatctaccgcttggttgagcaggaagcgcatgtagaaggcaaaaaaagaaagagggtctggatcgattcccagaccgaagaagagattttgcgcggaatcagggaggcgaaggatttatcggaatacgataatctcagtgcctctgcttatttgagggcaaaggaagattatctgatggggatcaatttttcccgtctcctgacgctgaaatatgggaacagcatatccaattatctgcgcagcaagtatgcggtcatatcggtagggcgcgtaatgacctgcgtgctggggatggttgtccgcagagagcgggagatcagggactttgttaagacaccgttctaccgtgtcctgagcaccattgaggcaaaagggcagaatttcgagggagagtggcgtgccgtcaggggatcccgcttcttcgaatcctttgacctgtacaaggagaatggatttaagaagagggagaaggcagaggaactggtggattacttgaaggaaccggaacccgtgacatgccagattacagccattgagaaaaagaaagagaaaaagaatccgccgctgctctataatctggcggagcttcagaatgactgctccaaacgattcaagatcagtcctgatgaaacgctcaggattgtacaggagctgtatgaaaagaagctggttacttatccgagaacggacgccagggtgctgtccgcagccgtggcaaaagagatcagcaggaatctgaacggactttccaagtacccggtggccgcgccttatctgcaggatatcctgggatttggaagccacaaaggcctggcaaagaccaggtatgttaacgataagcagattacggatcattacgcgatcataccgacggggcaggggctgggggccctcagctcggtttcctcgacagcgtcgagagtgtatgaatgtattgtaagaagatttttgagtattttttatcccccggcggtgtatcagaaggtgtccattaccacaaagatcaaagaagagagtttcttttccagttttaaggtactggcagaggaaggttacctgaaagtgacgggtgtgcctcaggcaaagaagaatgtttccgcacagggaaaggaaaacaatgcggaaaccggagaaaacagcggggacggtgacagcggtgagaacagcggcgctcaggatctggataccagtttcttccaggtgatacagagtctgaagaagggtgctgtccttcctgtgaaggcattggatataaaagagggagagacctctccgccgaaacggtacaattccggttccattatcctggcgatggaaaatgcagggcagctcatcgaagacgaggaactgcgtgcgcagatcaaaggaagcggaatcggaaccagtgcgacacgtgcggagatcctgaaaaagctgatccatatcgagtatctgggcctgaataaaaagactcagattattacacctacactgcagggcgaaatggtgtttgacgtagtggataattccatcaagtcgcttctgaatcccgaactgacggccagctgggagaaggggctgacttatgtggcagacggtgatattacgccggatgagtacatgaaaaagctggatcactttatcgtcagcagaaccaacggagtaaaaggactgaacaaccagtaccagctccgcggatgctatgaccgtgcagccagattctataaagaaaataagggaaaaagtaagtaaggagcagaggcgtgttagaaatattggttaccattccggttgagcagcggcaccggcaatacctggaagatacagccgcccatattataggcagcggcggcgctcattttgtatacagagcgcagaaggacgcggatcaggagatggtcgaaaaggcagatattatactgggaaatgttaagccagagtatctgaagtatgctgcgggtcttagattactgcagctggacagtgcaggggccgccctttatactgttccgggcgttatacctcccagtgtaaaactggcgaatgccacaggagcctatgggctggcgatctctgaatatatgcttggagcctcgctgatgctgataaagaaactgcatttatatgagcgcaatatgcatgcacatgtatggaaagatgaggggcaggtgaattccattgctgactctgtgaccctggtcgtaggcctgggcgatatcggcgggcagtttgcacagaaaatgcacctcatgggcagccatgtcataggaatccgcagaaatatggcacaaaagccggattatctggaagaattatatcagctggatgcactggatgcgctgcttgggagggcggatattgtggcatgtacgcttccaggcaccccgcagacagagggactgttctgccgggagcgcctggagaaaatgaaaaaaggggcaattctgctcaatgttgggcggggaagcctgattccaaccatggatctgtgtgatgccctgcacagcggcaggctgggaggtgcggccattgatgtgacggagcaggaacctctggagccggattctccgctgtgggatgcgccgaacctgctgatcaccccccatgtggcaggaaagtaccatatgcagcagattttggaatctgttgtagaaattgcggcatataatttaaaagcaatcctgacagacggtaacataaaaaatgaagtagattttcagaccggctaccggatgttcactgagccggcggagaagtaggaggaaaagaaaatgacggaattaactgtaaaagagctttatacactggaagagacaattgctgccggtatattcgacggtgtgacctatccgtgggaagtcctgccgaaaatcagcggctttattctggagctgggaaagactttagatgaggaagagtacgaaaagagtggtgagaatatctggattgccaaatctgcaaaggtggctcccactgcatatatcaacggaccggcaattatcggaaaagaagctgaggtcaggcactgcgcatttatcagaggcaatgcaatcgtaggcgaaggcgcggtagtcggcaattctacagaattgaaaaacgtgatcctgttcaataaagtacaggtaccacattacaattatgtgggagattccatacttggctacaaatcacacatgggagcaggttctattacctccaatgtaaaatctgataaaaaactggtcattgtaaaaacaccggaaggaaacattgagacgggtatgaagaagttcggcgccatgctgggtgatgaagtcgaggtagggtgcggcagcgtgctgaatccgggaaccgtggttggaagccacagtaatatctaccctctctcatctgtcagagggtatgtgccggggtggagtatctataaaaaacagggggaagttgtaaaaaagcggtaagtaatttgaacgacgaattctagcatgtgtacggatgaaagggggacgcctgccgtggaaataggacaggggcggtctatggagggatccttcataggccgccccgttccgttccacggcaagcgtccctctttcatccagacggctgtgcagatgcccgtctccatcactttacaggctcgaatgccgtacagcgcggtgcacggctccctgaatcgtaataatatggcttcacaatgtgactagaaagggattgttttattcgctgaggggtgctaaaattagtttacaaagctatcattcttagatttctttttataaatgcggcgttcgtccaaaatattccatggtctttaaatgaaaaaagtaactgctagtacatattgacactaaaaatcttaaacattaaaatgaggccaaaaccgagcttaaaacggtatataatgaatcaaaagctattgttttgcatgatttctggacatgactaataagcggcatgacagtcggtttgcaaaagtaactgagaccccgcttcgatttatgatatgaggcctttgtttgatccgacagatttgtatttagtgtttaattagttttggactcagaataacctcatcaggtggaatgggtgacaggttaagtgcagataatagctttttttcatctgcagaatccattaaatcaaaaggtgttttgccatccaggttgtcacgtataacgctgttgatgtgacaacaaataagtcgtgtatcttcaacattaagcttatttagactagttccctttggaatgattcttcttattaatctgtgattgttttcaacatgaggcttctgccaagaggcctgaggatcacagaagaatacatgagtacgaataaaccctggacgtgtgtgctctaaggcatttgggttcttgaactcaacaccattgtcagtgagtattacaccgaaaagtcttttaaagagagcagtgccaagcaagctgcttaatgtatcaaagacctgtataacactatcctgagtaccgtcattcattagaaatataagcatgaagctggactttctaaatatcatagtgagaaatactttgcctttttcacggcttcctttcactgtgtccatctcaacgacagaaagttcaggattggcttcgacaaaggaattgaaatcctcaatagtgcggccttgtctgtattggtattcaagtttggtaagaactcttttaggacggcgttgtctataaacaaccttctttggaagatcaatgtttcggaccttaaatacgttcttatctatgtagttataaagggttctttcagaaagaccaagttcatctgcatgtgccctgcatatgtgatttagggactgccctttagcaatcaagggttcaataatctctgatatttcgcgcagttccttaggtgtttttcgaacaccgctgtgagcgttcttgatggatttgtgatgagctgcattggctttatgagcggaataataggctttgtttttcttgcagcctttctgcatcttacagttactgcaaacatagggaggcttatcaagcaaatcgcattgaaatgaatcatagttgtcacaaattgatgtgcagataatacctactggacaacgcttacaccgtgaggcaaagcaaccatgaacacccatttcaggacaaagggtattgcgttggcaactaggacgattaatacaatcgttttcccccataagtggaattctgcttgtaaagcagcgatagtgcaaaacttcacgagctatggtggaagcggacctatccaggtttcttccaatagaagcaaatgaataatctttgtggatcatttgctcaataacaatacgttcaggtaaggataattgtttagccataataactccttcctgatcaaacaaaggcaccttaattataagcctttgcaaaagtagttgctagtttgcaatcgtagttgcaagcaaaatcaagcgtttaaaaatgcaattaaagaggaaaagtataaaagaaaagtcctgtttataggacatgtaaaattgtataatagggttatgaaattgttgttgacattttacaacaagtataatagtatattattagaaaacgaacaattgttcgaaaattgagaaggagagtaccgacatatggctaatggaaatgaagataagaaaaaagcgctggaagcggcgattgcgaagttagagaaagattttggaaaagggacggttatgaagctcggtgaaccgggagcccatgttgcggtggagacggtgccgacgggctgcctgagcctggatctggcgctgggactgggcggtgtgccaaaggggcgtgtgatagaagtctatggaccggagtccagtggtaagacgaccgttgcattacatatgattgcagaagtacagaacaggggagggattgccgggtttattgatgcggaacatgcactggatcctgtatacgcgaagagtattggcgttgatattgatgaactttatatatctcagccggacagcggggatcaggcgcttgagattgcggagacaatggtacgttcgggggcgattgatattattgttattgactctgtggcggctctggtgccgagacaggagatcgaaggggatatgggtgacagccacgtgggattacaggcgaggctgatgtcacaggccctgagaaagctgactcccgttatcagtaagtctaactgtgttgttattttcatcaaccagctgcgtgagaaggtaggcgtgatgtttggaaatcctgagacaacaacgggcggacgtgccctgaagttctacgcatctgtcaggatggatgtcagaaggatcgagactctgaagcagagcggcgagatggtcgggaaccgtacgagggtcaagattgtcaagaataagatcgcgcctccgtttaaagaggccgaatttgatatcatgtttggaaaagggatctctaaggagggggatattctggatctggcagcagggattggcgtggtgaagaagagcggcgcatggtatgcgtatgaaggcgagaagatcggacagggaagagagaacgctaaagcatacctcacggagcacccggaagtgatggaagagctggaccgcaaagtgcgtgcccactataagctgaacggtgaaggagaggaagaagcagcggaggaactgaagctgacaaagaaggcaaaggactcaaaagcgcccgaaccgggaaaaacggaagtgaaagcaccgggggaagcataggatgacagttacaaagctggacgctgtaacgaaaacaaagtctaaagtctttctggacggccagttcgcctttgtcttatacaagggcgaactggcccgttatggtatcaaagaaggagcacagatcgaggaagagaattacagggaggttctggaaaaagttgttataaagcgtgccaagttaagagctatgcatcttctggaggatatggatcgcaccgagtccgggctcagggataagctgaaacaggggttatacccggaggaagccatagacgccgccttgtcctacgtgaaatcatttgggtatattgatgatgagcggtatgcaagacaatttatagagagcaggaaggcgtccaaaagcaggcgcgagatttatgccctgctgtgcggcaggggtgtggcgcctgaaaaaattgaactggcattcgaggaatgctttgaatccgataatgaaaaggatgcaatccggcagattatcaggaagaaaagggtgattccggcggaggcgacagaggaagaaatgcgtaaattatatggctatttatcgcgaaaagggttccgttatgacgacatccgtcaagtgatacaaaataatgatgagaatgcttgacatagttgtgaaaacagtataaaatttaactgttgtattttaagcaagaatgtacaatgaaaattgaacaaggaggtgctcctgtgccaacaatgataagtattgttattgctgtagccctcgcgttgatagttggtattattactcactttgtaacgatatccaatctcaggaagaatgcagattccaagattggcaatgccgaagcaaaggcaagagaaataattgatgatgccgtaaagactgctgagacaacgaaaaaagaagctcttttagaggtgaaggaagagtcgatcaagacgaagaatgaccttgaaaaagagacaaaggaaagaagagccgaattgcagcgttatgagaaaagggtgcttgcaaaagaagaggccgttgataaacggtcagaggcgatcgaacagcgtgaagtcaaatttacagcaaaagaagagcaactgaagcagcgtgaagcaaaagtagaagaacttagtcagaaaagagtacaggaactagaaagaatctcaggacttacctccgaacaagcaaaagaatatctgttgaaaactgttgaagaagatgtgaagcatgacacagccaagatggtaagagagctggagacacaggcaaaggaaaatgcggacaagaaggccaaagagtacgttgtcaatgcaatccagagatgtgcggctgaccatgtggctgagactacaatttccgtagtgcagctcccaagtgatgagatgaagggaagaatcatcggccgtgagggaaggaatatcagaaccctcgagacactgacgggtgtcgagctgattattgatgatacgccggaagcggttgtattgtcaggttttgacccgatcagaagggaagtagcaagaattgcccttgagagattgattgtggatggacgtatccatcctgccagaatcgaggagatggtagaaaaggcacaaaaagaagtggacacgatgatccgggaagaaggagaggcagcgtctctggaagttggcgtgccgggaatccatccggaattgattcgtctgctcggacgaatgaagttcagaaccagttatggccagaatgcgcttaagcattctatagaggttgcccagctgtcaggacttctggccggtgagatcggcctggacgtcaggatggcgaaacgtgccggactcctgcatgatatcggcaaatcaattgaccacgacgtggaaggttcacatattcagattggcgcagatctttgcaggaagtacaaagagtctccgacggtaatcaatgcagtggaatcacatcatggtgatgtagagcctcagacattgattgcatgcgtagttcaggcggctgacacaatttctgcagcaagaccaggtgcaagaagagaaacaattgaaacatacacaaacagattgaaacaattagaagaaatatcaaaccagtttaaaggtgttgaaaagtcttttgctattcaagcaggtagagagattcgagttatggtagttccggaccaggtatctgatgatgacatggtacttatggccagagaaattgcaaaacagattgaatttgagttggaatatccaggccagattaaagtaaatgtaattcgcgaatcgcgcgttacggattatgcgaaataatttatatcagatcaagtttagcccttgtcgtaagacgagggctttttttatgatataggaaattcctttggaatttcctatatcataaaaactctacgggaggatgcacacgccgcttcgcgcttccaggcgggagagtagagctggaggagttagacatgcgtgaatgggattgaagatagaaatgaagggatattggaggaaaattgcaaaaataagaataaatttgcgcaaaatgatgcgaaaataatggattaggaattatgcggaaatataacttgcaaatattggcagcgtatattataattaataaccataatgtgttatttatattttatatgtagaatgtatggaattggaggatgttaatatgtcacttagtttatcaagaaaggctgcgagcgtgaagccttcatctactttggctattactgcgaaggcaaaggctttaaaggcggaggggattgatatcgttggatttggagccggcgagccggattataatactccggataatattaatgaggccgctatcagagctattaaggaagggtttacgaagtatactcccgcatcagggactgtggaactgaaaaaggcggttagtgataagttcagagagtttaatggtcttaactacgagccaaatcagatcgtgatcagcaacgggggcaagcattctctgacaaatatttttgaagtgcttctaaatccgggagatgaagtgattattcctgcaccgtactggcttacttatcctgagattgtgaaactggcggatggagttcctgtatttttgtatggctccaaggataatggatataaagtgactgcaaagcagattcgtgaagctgtgactgataagacaaaagcttttattttaaatactccaagcaacccgacgggcatggtgtactcagaggaagaacttcgcgcaatcgctgagattgctgttgcaaaggatttttatgttgtagcggatgagatgtatgagtatcttatttatgatgggaagaagcatgtgagcattgcttcccttggtgaagagatttataaaagaaccatcacctgcagcggagtttccaagagctatgcaatgacaggctggagaatcggatatacgggatccagcacagaaatcgcaaagatgatgggcagcgtgcagtcccatcaaacatccaacccgaactctatcgcacagaaagccgcattggaggcactgacaggggatcagtcggcgctcgaggagatgagggttgaatttgataagagaagaaaatacatgtatgagaggatttcggcaatgccgcttctggatctgttggagccggagggagcattttatgtgttcgtagattttaccaatgtcctcgaaaaatcttacaagggtcaaaagatcggtactgcggcaagagcggcggagattctgatagaagattaccaggtggcggttgtcccctgcgctgattttgggtttgacaattttgtacgtttgtcttatgctatttctttagaagccattgaaaaagggctcgacagaatagaaaagtttgtgtcctcactgtaggaactaaaaaggagcattttatgagcggacaaattaaaagattaaaccgggaactgaagtttaaaggcaatattattgacttttaccaggacaccatggagattgacggcgatcataccgtgacctgggattttatcaaacacaagggtgcggctgcggttgtgccggtcaccgatgacggcagaatcctgatggtgaagcagtaccgcaatgcgctggaacgtgatacactggaaatccctgccggagctctggacaaagaagatgagcctgggattgtatgtgcaggaagagaactggaggaggaaacaggctatcggagcgaggatctggactggctgattacactccgcacaacagtggcgttctgcaatgagagaatcgaagtctacgtagcccggaatctgatcccgtcaaagcagcatctggacgaggatgaatttattgatttgaaagcttatacaatagaagaattaaaggaaaagatttttgctggtgagatacaagatgcgaagactgtctccgcactgcttgcctatgattcgaaatacggaaaaagagaataaaaaagaaaccccggcatataatgaaatatcttagcaataggaggaacgcctgtgaagatacttcatacgaggaagcagctgtttgctttcttcatgccgggttttttattggggatactgtatgtgaatctgattatgaagcaatatacagcagagcccggaatattcagcgactattttttaaaacagtatcagtcagtctccattgtggccgaggaatacatatggtatctgatcaagatccgggccgttccgtttcttatcctgctgggattggcattcacaaaaatgcggaaagcggcctccatagcatttctggtatggacgggcttttcaagcggcatgctcctgtcaatggcggttctgagcatgggaatcaagggaagtatcctctgcatcgtaggaatcctcccccagttccttctctatgttccagcatacatggtcatcatctggtacagttatacatatccccaaaacaaatggaatacacagaaaagtatctttctgggactcaccatgctagtggggattatactggaagcatatgtaaatcctatacttatgcaggggtatcttgggacactttagtgggggaggggtgccccgtgaaccggacataggggcagctggaaacgggttatggctgcaagctggagtagagcaaaaaggaaggacaacagaggcaacctggccacatcacccgaagcctgatggcttcgcgcgctggggccaggaatttttgtgattcggaatcacaaaaattacctctgttgtccttcctttttgctcaactccagctaacagccataagacgcttccagctgcccctatgtccggttcacggggcttgtctcatccaatgggaagtgccccatgcctcgggagggcagcgctgacggggccggtggatctggactggcggcgcggtaaatgttggaaagtaaagatgcggccctatatttgcttgcctatgaatgcatcccacgcaaacccaatcccatacgctgtccccgtaagaaagccccgctggaagcgatgcttacctccgatttgatgaagccaagcctgcctgagatggggaacggatgcctcgggaaaaaaaggagcgggggctgggagtatagagcgcatggtttagaagtccttacgcaaaaggaaccgcccatgagggatgaaaagtgatttaccaaatcacttttcagtacaacctaagacgggaaagcatcaggctttcccgttgcatgttgtacgtgccctcatgggcggtttcttttgcgttaggacttctccataagcgggttactcccagcccccgctcctttttttcccgaggcatccgttccccatgtccagtttcaggacataggtaagtaaaaagtttcaggacataggtaagtccaaatgttaaactatacagaaataaccaacgaaagaaggtgtttctgtatgccatggaaggagacctctgttatggaacaaagtaaacaatttattacagaatatctatgtggaactgatagctttaaggctctctgtcaaaagtttggaatctcagaaaaaactggacataagtggaaaaaccgctttctggaatttggcttctccggcctcgcggatcagagcaaggccccttctaattctccgaatcagctggatgaagataccgtcattcgtttaattaaaatgcgttccgctcatccggcctgggggcctaagaaactggccgttctttacaagagcgcttatccagagtcgccaacaccatctgagagtagtatttatcgcattttgggaaaagctgggttgattcccaaacgacgctttcggcatcccgatccaactgtttccaaactgcgtaataagttggaagctcttcaacccaatgatgtctggaccgttgattttaaaggctggtggatgtcccagggggaacgctgtgttccactgaccgtccgtgatctgcacagccgatacattcttaccatccgcctgatggagagaacaactgcggatgctgtcaaagctgtatttgaagaattattctatcactacggacttcccaaaatcattcgcagtgataatggtactccttttgcttcctcaaatggcttccttggtttgacaaccttaagcgcatggtggatgtctcttggcattcttccggatcgtaccgatccaggctgtccaacgcaaaatggtgcccacgaacgcatgcatgcagatataagcagggagattcaaggaaaaatacctggtggcagagaggccaatcaagccgccattgatttgtgggtggaagaatacaacaacatccgcccacatgaagccttacaaataagtaccccctccgatttttataaaaaatctaccctgctatacgaagaagcgttagcagaactggaatatccgattggttacctgccaagaaagattaacaaacatggagaagtaaaaatcaacaaaacactgtattctgtaagttcatcacttcgaggcttacaggtaggagtgcagccaaacggtgataaaacatatatcatttggcttcacgactttccacttggaatgcttgatacaaaaaccgcttgtataacggcaatggatgttttaaactgatactaattaacaattcgacttaccacctgttgaatcgacttacctatctcctgaaacaaaagacttacctatctcctgactggtcaccatctcaggcaggcgtccccccatccgctcccctcgtccctcgctccctatatttcttttttgagtacgattccggcacagatacttacgatcagctggctcgccagcattccccagaggtatccctggattccgaacagggggatggctgcgaatacgctgccgatccggatgagcagtccgagggagttgatgaggaaggtataagccgttttgcccagaccgttgatgacgcttaacagggcggagtttgtgtataaaaacgggcacatccaggccagagtgatgatgaatttgccggcagtggaacttccgaacaggacagtgcccatccaattaccaaggactaggaaaatgaagcagcagctcaggcccaggatgaaacaggatccggccaccttttttataatgttgaccatatcatcccggttgtctgtagtctgtatctctgcaaccgtgggcatgagcatgatggagatcgaactggtgatggcggatgggaaaaggatacagggcagggccataccggtcaggactccgtaaatgctgagcgcttcactggtcgaatggttgtatagctgcagccgtgcagggatcgagatggcctcgatactctgcaaaaggttgatcagtacccggttggcggtcaggggcagtgacaggggcatcaattctctgaaacgatggacaaaatctgtatatgtaatattcaggtgtgacagtacatgactgctgcgcgtaagggacttggctgcgtacagagctgatagcatttcgccgatgacgaggccgaggacagcgatcgtgattgtgacgtcgtctccttttttcatcagaattaagtagaaaacataaacagaaataattctggttacctgttctactacctgggaaagagccgggatttttgtttccttcatgccatagcagtatccgcagatgcagctgtggatggccgcaaacggcagtgcgtaggagagcggaatcagcaggggttcacagcgggcgtctcctagtaatttttcggctatgtaggctgcatttccctgcaggattaagacacaggcacaggacagcagcacggataggacgagaccgagcatgaggatctgccgggcttctttttttcggccaagggagaccttctgggcgaccgtcctggatatggcggtttccaatcctgcggcggtgagtgcaaaacagagtgaatagaccgggaaaataagctggtacaggccgacgccttcttcaccgaatgtatggctcagaaaaatccgatagaagaatcccataaaccggcacagaaatccggttgcggtaagaataaaggttccgcgtatgatggtttgttttctggacaagggtatctcctaaaaaaacatatttttacaacatattcctgtttctgtcttgacagaactgaaaacgagtggtattctacaaaagaagaaatcctagtaaattactagggaatgaaaagataggaattaaagtactagggattaaaacactaggaattattttaggtctctgtggaatgctaaaccaggacagaaccgggttggcggagtatgaatcagtaagaaggtgatgatttgaaattatctacaaaaggaagatatggtctgcgtgcgctgattgaccttgcacagtacagcgagaatgagccggtttccattacaaacatttcggacaggcagggaatatccgagcggtatctggagcagctgatgtctatgctgaaaaaagcgggactggtcaaaagtatccggggcgccggcggcggctatgtgttggcaaaggatttggaagagatatctgtgggtgatgtgctgcgggccctcgaaggcagtttggagccggtagagtgttcgggactgcatcccgaggagggctgcaaagcagcggacagctgcgtcactaaatatgtatggcagcgcatcaacgagagtatcaatcagacggttgatgagataaagctcgcccagctggtcgaggaaagcaagaagatgggatgccaggatatacatggacagaccggatgtaagaattaagggcgtttatgatcctgcgtaaatataaaaggatgactgcagacaaaaaccggatcagccggctgatacttataaggaggatgtataaaaatgaataaactgatttatttggataatgctgcaaccacaaagacagcaccagaggtagtggaggctatgcttccttattttacggaatattacggcaacccgtccagcgtttatggatttgcagctgccaataaggatgtgattacaagacagagagagatcatcgcagaggcgatcggtgcaaaagggaatgagatctattttaccgcaggcggttcggaagcggataactgggcgctgaaagcaactgcggaggcttatgcagcaaagggcagacatattatcacaacgaagatcgaacaccacgccatactccacacggcggatttcctgaagaaaaacggatttgatgtaacatacctggatgtagacgaggacggcaccgtgaaattggatgagctgaaagctgcgattcgaccggataccatattgatatctgtgatgtttgcgaataatgagatcggtacaattcagcccatccgcgagattggtgagattgcgcatgagcacgggatcctgttccatacggatgcggtgcaggctttctgccaggtgccgatcgatgtggatgcctgtcatattgatatgctcagtgccagcgcccataagctgaacgggccgaagggcattggcttcttatatattagaaaaggcgtgaagatccgttccttcattcatggtggcgcgcaggagagaaagcgccgtgcgggcacggaaaatgtgccgggcattgtcggttttggcaaggcggtggagcgtgcggcaggttcactcaaagaacgcactgcaatagaaaacgagctcagagactatttgatcggaaggattgagaaggagataccttactgtaggctgaacggccacagacaaaacaggcttccgaataatgtgaattttagttttcagtttgtggaaggggaatctcttttgatcaaactggatatgaacgggatctgtgcatccagtggttcagcctgcacctcaggttctctggatccgtcccatgtgctgcttgcaatcgggcttccccatgagatagcacacggctccctgcgcatgacgctgagtgaggagacgacgaaagaagagctggattttgtggtagaaaagctgaaaactatcgtaggggaattgcggaatatgtcacctttatatgaggattttataaaaaaacaaaccagataacaggaggaagaatatatgtattcagaaaaggtaatggatcactttgaacatccaagaaatgtaggagaaatagagggtgcaagcggagtcggcaccgtgggaaatgcaaaatgcggagacatcatgcgcatttacctggatattgatgaaaatcagattatccgtgacgtcaagtttaagacatttggctgtggtgcagcagtggcgacaagcagtatggcaacagaactggtgaaggggaagaatatccaggaagcaatgcagattacgaacaaggcggttatggaagccctggacggacttccgccggtgaaggtgcactgctccctgctggcagaggaggcaattcatgccgcgctctgggattatgccgtgaagaacgatattaagatagaagggctggaaaagccgaagtcagatatccatgagggtgaggaagaagaggaagaggagtattaatgagcaaagtagtagtcggaatgtccggaggagttgactcctcggtagcggcctatcttctgaaggaacagggatatgacgtcattggtgtgacgatgcagatctggcaggatgaggaacgggcggttcaggaggaaaacggaggatgctgcggcctgagcgctgtggacgatgccaggagggtggctgcggatctggggattccatattatgtgatgaattttaagcaggaattcaaagaacatgtgattgattattttgtggatgaataccgtaacggcaggacacccaacccctgcatcgcctgtaaccggtacgtgaagtgggaggctttgctgcacaggagcctggcaatcggggctgagtacattgctaccggccattatgccagggtagtgaagctggacaatggacgttttacactgatgcgttctgcggctcttgcaaaggatcagacctatgcactttataatctgacccaggaacagctgaaacacacgctgatgccagtgggagaatacgcaaaggacgaggtgcgccggattgccgaaaaaattggccttatggttgcaaacaagccggacagccaggacatctgttttgtgccgggcggtgattatgcatcttatatagaagaaacagcgggaatcagggttccggaggggaattttgtgagcagtgacggccatgtgctgggacggcacaaaggcattacccactatacggttggacaacggaaaggcctggggcttgccctgggatatcctgcctttgtgctggagatccgtccggagaccaatgaagtggtgatcggtacaaacgaagagtccttggcccatacgcttcgggcaggaacgctgaactttatgtctgtagaagatttgacggaacctttacgagtttttaccaaaatacgctataaccataagggggcatggtgtataatagagaaaacgggaggcgatgaggtgctctgcactttcgaggagccgcagcgggcggtgactcccggacaggctgttgtattttacgacggtgaatacgtactcggcggagggaccattttatgataaccagtgattttcacatgcatactaacttttcgattgacagcgatatttcccccagggacatgatagagggcgccctggcaaagggattgacgacaatctgtataacggaccacaacgacaaagactatccggttcacgaggatattggaatggaaggttcccttttcgatttagacagatattttcaggaactgggggcgctcagggaagaatatgcggataggattgatgtgcgcatcgggattgaaattgggctgcagcctcatctgggggaatactataaagaattagtcagtcaatatccctttgattttgtgatcggttctgtccatgtggtaaacggggaagatccgtattatcagaaaatgtttgaaacaaggacggatgaagacgcatatagagagacatttgaggtaacactggaagatatagagtccgtgcaggactttgatgtgctgggacatattgattatgttgtgcgttatggaaaaaaacaggcgcaggagtacagttaccggaagtatgcggatatcctggacgagattctgaaaaaagtgatttccatgggaaagggcattgagatgaatatggccggattcaagtacggtctcggcttctgccatccgcatccggatgtgatcaggcgctacagggaactgggaggagaggtgatcacaatcggtgccgacgggcaccggccggaacacattgcctacgattttcagaaggcaggggacatcctgaagggctgcggctttaaatactacacagaatttaagtccagaatgccgatttttcaacaacttccataaaaatatatttagcacttgaatttttgttcttgatttagtacaataaaccgtagttgatgaatctttaacaaacttgaggtttgctgaaggtttcacaataaaataactgtgtaacagttaacaactttcaaaactttaggaggaattaatcatggcagtaaaagtagcgattaatggatttggacgtattggacgtctcgcattcagacagatgttcggaacagaagggtatgaagtagttgcaatcaacgacttaacatctccgaaaatgttggctcacttattaaaatatgattcaacacagggaaaatatgcacttgctgacaaagtaacagctggtgaggactccatcacagtagacggaaaagaaatcaaaatctatgcaaaagctaacgctgaagaacttccatggggagagattggtgtagacgtagttctggagtgtacaggcttctatacatcaaaagcaaaagcagaggctcacatcaaagcaggcgctaagaaagtagtcatctctgctccggctggaaatgaccttcctacaatcgtatataatgttaaccacgaggagctgacaaaagaggacaacatcatctcagcagcttcctgtacaacaaactgtctggcaccgatggcaaaagcactgaacgatctagctgagatcaagacaggtatcatgtgcacaatccatgcttacacaggcgaccagatgacacttgacggaccgcagagaaaaggcgatctgagaagatcacgtgcagctgcagtgaatatcgttcctaacagcacaggtgcagctaaggcaatcggcctggttatcccggcactgaacggcaagctgatcggagctgctcagcgtgttcctaccccgacaggatccacaacaatcctgacagcagtagttgaaggaacagtaacagtagatcagatcaacgaagctatgaaagctgcttccaacgagtctttcggatacaacacagatgagatcgtatccagcgacatcgtaggaatgaactatggttctttatttgatgctactcagacaatggtactgcctttggacaacggaacaacacaggtacaggttgtatcctggtatgacaatgagaattcttacacaagccagatggtaagaacaatcaaatactttggaacattactgtaagtcggtatttcggaaaatataatcggcagattaatttctaaaaaatagactcacaaagggtccggtcttatatagggccggatcctttttttatgaaatataagggataggatagtgtgactgctctatccctagaaggtaattattaaacaggaggcaataagatgctcaacaaaaaatcagtagacgatattaatgttaagggtaaaaaagttcttgtaagatgcgattttaatgtaccattgatcgacggaaagatcacagacgagaaccgtcttgtggctgcactgccgacgatcaaaaagctggtggcagacggcggtaaagtgatcctttgctcccacctgggcaagccgaagggacagccgcttccggaattatcacttgcaccggtcgctgtcagattatccgaactgctcggacaggaagtaaaatttgcagcagatcctgaggttgtaggatcaaatgcaaaggcagcagtagaagcaatgaatgatggagacatcgtccttctcgagaatacgcgctacagagcagaagagacaaagaacggcgaggccttcagcaaagatctggcatctctttgtgatgtttttgtaaacgatgcattcggaacagcacatagggcacactgttcaaacgttggtgttacacagtttgtagagaccgcagtagtaggatacttaatgcagaaagaaatagatttcctgggcaatgcagtagagaatccggcgagaccttttgttgcaattcttggaggagctaaggtttccagtaagatttcagttatcgagaaccttttggacaaggttgacaccctgatcatcgggggcggaatgtcttatacattcagcaaggctcagggcggaagcgtcggcaaatctcttctggaagaagattactgccagtacgcgctggacatgatcaaaaaagcagaagaaaagggcgtgaagcttcttctgccggttgacaacgtgattgcagatgatttctccaatgatgcaaatacgaaagtggtaggacgcggggagatcccggatggctgggaaggactggatatcggacctgagactgctaaattatatgcagacgaagtgaagagtgcaaagactgttgtctggaacggaccaatgggatgcttcgagatgccgaactttgcggcaggaacagaggcagtggcaaaagctctttcagagacagatgcagtgacaatcatcggcggtggtgattccgcagctgcagttaaccagctgggatacggcgacaagatgacacacatctctacaggcggcggggcttccctggaattccttgaaggaaaagaacttccgggcgtagcggcagcaaacgataaataaagaattgttgtaacagttcagacaggcctgaattattacagattgttaactaatttaagataaaaggagaccatatcatggcaagaaagaaaattatcgcaggtaactggaaaatgaacaagactccaagtgaggcagtagcgctggttgaggagttaaaaccgctggtggcaaacgaagaggttgatgtagttttctgtgtacctgctattgatatcgtaccggttgtagaggcttctaagggaagcaatatccaggttggcgcagagaacatgtattttgaggagagcggtgcttacacgggcgagatcgctccggctatgcttgttgatgcaggggtaaaatacgttgttctcggacattccgagagaagagaatattttggtgaaaccaacgaagacgtaaacaaaaaagtgctgaaagcatttgagcacggtatcacacctatcatgtgctgcggagagtcactggagcagagagaacagggcgtgaccatggatttcatccgtcagcaggttaaggttgggttccagaatgttacagctgaccaggctaagacggcagtgatcgcttacgagccaatctgggcgattggaacaggaaagactgctacaacagagcaggctcaggaagtatgcgcaggaatccgtgcatgtatcgctgaagtttatgaccaggctacagcagaggcaatccgtattcagtacggcggatctgtaaatgctgcaacagctccggaattatttgcacaggctgatatcgacggaggacttgttggtggtgcatctctgaaagcagatttcggtaagattgtaaactataaataattcgcaagtgcagatattagcggtaccggctgtcgtaagaggacggataccgcagggaagggaatcgtggggagtgcaggaaaagctcgccacgattttcttgcgatagagaatgtcacgaacaaagcaggaggctgaatatgcagtatgagataattccgatccgggcggacggatctgctgaagatacaaagttttatgcatatattttaaagagttctatggattttcaaggggatgtttaccgtcccatggtgattctctgtcctggcggcggatacgagatgaccagcgatagggaggctgaaccgattgccatgcgtcttttgagcatggggtaccatgtgggtattctgcggtattccgtggcgcctgcacgttttccgactgcgcttctggagctggcagaggtgatgaagctggtgcacacaaaccgcgaaaaatggcatgtaaatacggacaagatttttatacagggttcgtcggcaggcggacatctggccgccagtctgggggtattctggaatcagccgtttctttgtgaattgtcgggtacaactccggagatactgaaaccatgtggaatgattttgtgttatccagtgatcacctcagaggaagaatacgcccatgagggcagcttcaagagccttctgggaagccggtatgaagaactgaaggacagggtttccatcgagaagcaggtgacatccgctgcacctccatgttttatatggcatacatttacggatgagaccgtgccggttgaaaatgcgctgttattcgttcaggcgctcaggaaggcaggggtgtccacggagtttcatatgtatcctgccggtgagcacgggctttccctgggggaccagacgagcgcacgggcggatggcagtatgatttgcgaaccggtacagtcctggatccatctgcttgagacctggctgaaggggatgacagattagatttgcaaaatccggagaaacaaggtacaataggttccggaatgcagtaattagataacaatgaaggagaataatatgagcaaaaaaccaacggtattaatgatattggatggatatggattaaatgataatacgaacggtaacgcggtggcagagggcagaactcctgtaatggataaactgatggcagagtgcccctttgtgaaaggaaatgcgagcggcctggcggtaggccttccggacggccagatgggaaattcagaagtaggacacctcaacatgggggcaggaagaattgtatatcaggatctgactaagattacaaaagcaatccaggatggggatttttttgaaaacaaggcgcttcttgcggctagcgagaatgtaaaaaagagcggctcggccctgcatatatttggtcttgtctcagacggcggtgttcacagccacaatgagcatatatacggtctgctggagcttgctaagaaacagggtatcgaaaaagtatatgtacactgtttcctggacggacgtgacacacctcccgcatccggcaaggactatgtagagcagttggaagcaaagatgaaagagatcggtgtcggtgaagttgcaagcgtgatgggacgttattatgcaatggacagagacaatcgttgggacagagtggaaaaggcatataaagcccttgtaaacggagagggagagactgcggcgtcgggtccggaaggaatccaggattcttatgatgcagataaaacagacgaattcgtgcttccgacggttgtcatgaaggatggcgctccggttgcaacaataaaagacagcgattccgtgatcttcttcaatttccgtcctgaccgtgcaagagaaatcacaagaacattctgtgatgacaactttgagggatttgacagaggcccgcgcattaagacagtattcgtttgcttcactgactacgatgtgacaattggaaataaactggtagcctttggaaaagatgaaatcaccaatacattcggagagttcctggcaaagaaccacatgacgcaggcgcgtattgccgagaccgaaaagtatgcacatgttaccttcttcttcaatggcggcgttgaggagccaaacgagggagaagacagaattcttgtaaaatctccgaaggttgcaacctatgacctgaagccggagatgagtgcttatgaagtatgtgataagctggtggatgcaatcaaatccggcaaatacgatgtgatcatcatcaactttgcaaatccggatatggtaggacacacgggagttgaagccgctgccgtgaaagcgattgaggcagtggatgaatgtgttgggaaagcggtagatgccgtcaaagaagtcaatggccagatgtttatctgtgcggatcatggaaatgcagaacagctgattgaccaggagacaggcgagccgtttactgctcatacgacgaatccggtgccgttcatattagtcaatgcagacccggcatacagcctcagagagggcggatgcctggcggatatcgcaccaacacttatcgaaatgatggggatggagcagccgcaggaaatgacggggaggtctttactggtgaagtagagacgcctgccgtggaaccgggcggggacgcgccggaaagggacagccgcaggccttcaagggcagtggctgtcctttttcagtgcttcctcatcccgcaccctgcattggaaaggcgccccttctccccaaaagtaaaaattttgtttaaccctcacgcattttagtgtataatgatctggtatctattaaattttttaaagaggactgaaataccaatgtatgataaattaaccaaaagtgatgtgaagaagatccaggaggagattgagcaccggaagctggtggtgcgccgggaagctatcgaggccgtaaaggaagcgcgggcccatggtgatctgagtgagaattttgagtaccatgctgcaaagaaggataagaataagaacgagagccgtatccgttatctggagagaatgctgaagactgccgtgattgtggatgatacttcccgtgaggacgaagtcggcatcaataatacggtggagctttactgcgaagatgatgacgagatagaaacataccggcttgttacgtcagtgagaggcagttcgataaacgggctgattagtatcgaatctccgatcgggaaagcaatactgggacatagagtgaatgacagagtatatgtgaaagtgaatgaggactacgggtattatgtagtgatccgtagcatcgttaatacacagaatgatgaagaggataagattagaagcttctaaagagaattagaagcagaaatgcgggttcccgcatagtggagggctgaaagaatggagattaagacggttttgtttgacctggatggcactttgacggattccgggccgggaattatggcaggggtacagtacgcactgaataaatatggaatggaagtagatgatttttccaggctgcgctgttttatcggacctcctctgaaggaacagtttcagaaattctgtggtttttccgatgaggaaggtgtccgggcggtggagtattaccgggagtattaccgggataaagggatttttgaaaatgaggtctatgatggcatatcggaacttttgcgggaattaaagggtgcgggtctgaaggttataatggcaacctcgaagccggaagcatttgcggttacgattgcagaacatttcgggatcagcaggtatttcgatttcatcggcggcagccttatggatggaaggcggacgaagaagtcggaagtcattgagtatgtcctggatgcagccggtgtggaggaacgaagcacggttttgatgatcggggatagggattatgatattctgggggcaaaagaggccggtgtccattcactgggagtcttatacggctacggttcacgggaagagctggcggcggcgggcgcggactttctcgcggagaagccggaggatgttcttagatacattgccggcaaagcaatagaagaatcgaaaaactgcaatttatagatagaaaatattgaaatattttacagaaatttatcttttcgggaagcataaattttaccgggattccttacaatagagacaacagtaaaaacatttggttcagattgtgagggatatatatgtacaaaggattatggactctgattgagaggcatgcggacgaagaatctgcggcggggctttatcttgcggcaaatattatttgctggacggcgggaacgatcctgctcggccttgctgcgtcagccctgatgcagaaaagtattgtcctggtactggtggatattgtatgtgcaggcgcatatgccggaatcattttcgggctgatcggaggaattttatttctgcagagaagagaaggcagcggaaacaggcaataatttctataaaaagacaccttcttcgtataggtcgaaattcggcttgtccacgaagaaggtgttttttgttttaaaaaaagaatccaggcagccccctcaattataaaggggctgccctaatgtgcatccgtcaggcacgggcatccttggatgggcaatctgtcagatcccactcatagcagcggcgccgacaggctttgccgcttcctcactcgggacctcctgtttttcttcggcatccgcttccatatttttattggccgtggagagcatgagtttaatccggttcagctgattcacttcactggcgcccgggtcaaaatcgattgcaaccacattggactgcggatacagacggcgcagctccttgatgacgccctttccgaccacgtgattcgggaggcaggcgaacggctgtgtacacacgatattgcctgcaccgctatggatcagttccagcatttccccggtcaggaaccatccctctccggtctggttaccgatggaaacgatgtcggaagccattctggccagatcctcaatatgcgctggcggatcgaaatggcggctgtcccggaacgcattggttgccggtgagcgaaaccattctacagccttgataccgagattacccacggtagccttggacttcttgaagcccaggtgtgaaaccttgaaattctggttatagaagcaatacagtaaaaagtccagcagatccggtacaacggcctctgcaccttcgctctccagaaggtcgacaagatgattattggcggccggcaggaacttcactaagatctcacctacgacgccgacgcggggttttttgatatccagggtctcgatcgtatcaaaatcatggataatttcccggcagagctttttgaatctgcgcctggaaggatagccgctggatacaaattctttacataccttcagccatttctgatgaacggcgttcgtggtaccgggcaccttttcatagggacgcatccggtagacgcacttcatgaaaatgtcgcccaaagtagccgcatacacgccgcgcagggcaagtgcaggggtaatcttgaagccggggttcccctccaggccgctcagattgatggaaataacggggatatgtgcatatcccgcctttttcaatgcccgccggatgaagccgatatagttggatgcacggcacccgcctccggtctggctgatgatgactgccaggtggtccgtatcgtatttcccggataaaatggcttccatgatctgccctacaaccatcagagatgggtagcaggcgtcattgtttacatatttgagccccacatctactgcctgtttattgtcattgggcagtacctccactttgtagccggatgcctggaatgcaggttccagcagatcaaaatgcatcggtgacatctgcgggcagagaatggtgtgggtctttctcatttcctttgtaaacggcaccttttcaatggaggcaggatgaatctcccgtttcgttttgcgctgctccctgacacggatcgctgcaagcagtgaacgcacgcggattctggccgcccctaggttgttgacctcgtctatctttagggaggtatatattttatccgaacgggtcaggatctctgcaacctggtcggttgtaaccgcatccagtccgcatccgaaggagttcagctggatcaggtccagattatctttcgttttcacataattggcggcggcatagagccgtgagtgatacatccactgatccataacattgagcggtctttccacctgctggagatgggagacagagtcctctgtgagaacggctatgttataggaattgatcagctccggcagtccgtgatttacttccgggtcaatgtgataaggacggcctgcaagtacgattccacggtttcccgtctcatccaggaagcggatggtttcttccccttttcgcttcatatcctcgcggcaggcagtcatctccgtccaggcttcgtggacggcggtgcggatctcgccctccgggatggagaacttgccggaaagctcttctgtcagcctgctatgtaatgtctcctcgctctggaaggagaggaacgggtggataaaatctacttccccgttaacaatcgcatccatattattcttgatattttcaggataagaggttacgatcgggcagttataatggttgttcgcgtcttcaaattcattccgctcatatggaacggaagggtagaagatatgctgcactccctggtcaatcagccactggatatggccgtgggccagcttggccggatagcattcggattcactcggaatggattcgattccaagctcataaatcttccgcgttgaagcgggggagagcacaacccggaaccccagtctggtaaagaaggtaaaccagaacgggtaattctcatacatattgagcacccggggaattccgatggcgccgcgctttgcctctgtatcttccagcggtgtatagccgaaataacgctcgctcttgtagtcgaacaagttcggcagtttattgacggacttttctcttccaagtcccttttcacagcggttccctattataaatctgcggtttccgctgaaatggttaatggtcaggcggcagttatttgtgcagcccttgcatttggtcatggtagtggtatactccagggcctcgatctcatcaattgggagcatggtagtaccttcgcactccacatagcgttccctggcaatcagggcggccccgaacgcgcccatgataccggcgatatccggacggattgcttcgcagtctgcgatcttttcaaagctccgcagcacggcattattgtaaaaagttcctccctgcaccacaatatggtttccaagctcagaggcatcagaaaccttaattaccttaaacagtgcatttttaatgacagaataagcaagaccggcggaaatatcggctacctcagccccttccttctgggcctgctttactttggaattcataaatacggtgcagcgtgtgccgaggtcgatgggattttttgcatacaaagcttcctgtgcaaaatcctccaccgaataattcagggactttgcaaaggtttcgataaaggagccgcagccggaagagcaggcttcgttgagctgtacgctgtctacggtctggttcttgatcttgatgcacttcatatcctgtccgccgatgtccaggatgcagtccacatccggttcaaagaaagaggcagcataatagtgtgatacggtctccacctccccttcgtccagaagaagggcggccttgatcagagcttcgccgtagccggtggaacaggagtgtacaatgtccacaccctccggcagctggctgtagatatccttgatggcgcggattgtggttccgagcggatccccttcgttattgttataaaatgagtacagaagagttccatcctccccgaccagggcggccttagtcgttgtggatcccgcgtcaattccgagaaaagcctttccctggtaggaggcaagatctttgacgggcacctcgtgttttgcatgacgctcgataaaagcgtcgtattccgtcgttgtggcgaagagcggctccatccggtctacttcaaattccatcttgatcttgccggcaaggcgctcctggagttcacggagcgctacattgacatctttcttagaactgagcgcggagccgatggctgcaaacagatgggagtgccccggagcaatcgtatgctcatcgtccagcttcagggtacgtacaaaagcggttcgcagctccgaaaggaaatgaagcgggccgcccagaaacgcgacatgtccgcggataggcttcccgcatgcaagtccgctgattgtctggtttaccaccgcctggaaaatagaggccgccaggtcttccttggcagcgccctcattaatcaagggctggatatccgattttgcaaatacgccgcagcgtgcggcaatcgaatacagagccttataattcttggcgtaatcatttaagccggcggcatcggtctgtaaaagagaagccatctggtcgataaaggaacccgtacccccggcgcatacgccgttcatacgctgttccacactgccgccttcaaaataaataatcttggcatcctcgccgcccagttcgatagccacatccgtctgcggagcataatcctgcagagcggtagagaccgcgattacctcctggacaaaaggaactgccaaatgtttcgccagtgtcaggccgccggaaccggtgataaccggtgagacacggatgggccccagtttgtaaatggctcttcccagcaggtcggaaagcgtctcctgtatatttgcgtaatgccgctcataatcggaaaaaagcacttcattgtcactgttcaggattgcaatcttaaccgtagtggagccaatatcaattcccaaagtatgtaaatcgtttatattcatagtatttccctcatcctttgaagcattatatgtcagttacttcttatttaatgtaatttatgtttttacaacaatttacattatacgacatgatcgaaaaaaagacaattgttattattaagcgggctgctggaatattcggacaaagtttataatatttaacaaattcctaaagttaaaaaagctaacatatgtttgacaaacactcggcaggactgtacaattacttcatgtaacagtaaaaaaattataaggagtagatgatcattgaattggttaaataagttagaaagaaagttcggacgttatgccatacacaacctgacgatgtacctgatcggcggttatgtgatcgggtatggtatcaggatgtttgtgccaaacctgcagtacatgctgacattggagccgggaatgatcctgcaggggcaggtatggagactgatttcctgggtcttgatagcgcccagcggcagcatatttacacttgtcattatggcgctgctgtactattctcttggaactgcgctggagcgtgcatggggatcgttccggtataatgtatacattttttcaggtattctttttacggtaatcggggcatttgtgctgtatctgatcacaggcggcatggtaggcctgggcggagccttcagcacatattacattaatatgtcaattttcctggcatttgcggtcagctatccgaatatggagctgctcctgtattttattcttcccattaagatgaagtggatggcatatgtttatggggcgattatcctgtattctctggtaaggggcaatatagcgacgcggattgtaatcattgcatcccttttaaattttgtggtgttcttcctgtccagcaggaatgtgaagccatatactccaaaggagaagaaaagaaaagcagacttcaaaaaacagtcccgcccccatatgacataccccaacggcgcacgtcacagatgtgcggtgtgcggccgtacagagctggatgatccgactctggagttcaggttttgttcaaaatgcaaggggaattatgaatactgccaggatcatttgtttacacaccagcatgtacagtaagcggtattgactggttttattgatatatcaagaaggagacataaaatgaagaaaacaaaagtagtatgtacaatggggcctaatacgaatgacagagaactaatgcggacgctgatcaaaaacggcatggatgttgccaggtttaatttttcacatggtgaccatgcagagcataaaagcagaatggacatgctgaagcagctgcgcgaggaggaacgggcaaatacggcgatccttctggacacaaaagggcctgagatacgtaccggagtgctgaaagacgggaaaaaggtgcagcttgaaaccggaagcacgtttactttgacgattgatgagatagagggcagcaataagaaagtatccatcacctacaggggacttgtggaagacgtggataaagggaaaattatactgatcgatgacggcctgatagggctggaggttgtgagcaaaacagagcgggatatcatctgtaccgttatcaatggaggggagttgggagaacgcaaaggcgtgaacgtgccgaatgtaccggtcaggcttccggcaatcacagataaggataaagaggatattaaattcggcgtcgagcaggatgtagactttattgccgcatcctttgtcagaaatgcagaatgcgtgctggagatcagagcctttttgaaggaactggatgctccgtttattccgatcatcgccaagatagagaatgcagaggggatacagaatatcgatgaaatcatacgcgctgcggacgggattatggtagcccgcggagacttgggcgtggagattcccgcagaggaagttccgtatctgcagaagatgatgatccagaagtgtaacaataatttcaagaccgttattaccgcaacccagatgctggactccatgatccgcaatccgcgtcctacaagggccgaggttacagacgtggcaaatgcagtctatgacggtacagatgctgtcatgctctcaggagagaccgcacaggggaaatatcccgtggaggctctgcagatgatggtgcatattatcgagaatacggagcagcatctggattatgagaccatgctggaaaaggccggggatcatcttcgcagcggcgtgtccagtgcaatcggatattcttccgtgctggcagcggcgaacctgaatgccaaatgcattattacgccctccgtgtccggtgctacggcaagggtggtttccaatctgaaacccaggcaggagatactgggtgtgactccgaatgagaggactctgcggaggatgtcgatctactggggcgtaaggccgctgaagtctttggaattcgataccacggaggatatctgtgacggggcaatcgagctggcgcttgtgaagcagtatatcgaagtgggcgatgtagtcgtattgacggcggggataccttcacctagtgtgaagaaagaaaaaagcggggttagcaacatgatgaggattgctacgatcgagtaagattttggggacggatgcgggacgatgaaagtacgcccgccgcaagcgtggcagtcccagctgtcacgcttgcggcgggctgcgtgcttcaaatcggcagaaagaaccgtctccacgggggatcctggcgggggcggcgaatttgaactggcttcgcggttcaaatttttctggggtgttttctgtcggagagggttagggatttacgtaagacagtgctggtacagagaaaaataaggttagattaacagtaagttgattattattcgatgcattagaaggtgtgatttattgggggcagtgcttgactattttataaatgtttgtattctggtggtttggggttgacagggggcgggggagtggagtatagtgttcctataaagtactactattgaaaatgctttggtatagggcaggagagattggaagtgatgggatgggggatgcgaggtttgttgagtatctgatgcattttggtgttaccagacaggaagctcttgtttactggacgcttttggttaaggggaagcagacggggtatgaggtggctaaggaggccgggatttcgcggtctaatgcctatagttcgctggcaggccttgtggagaaaggggcggcttatttggtggaagagtctgcgaagcggtatattccggttgctctggaggagttttgtgagaattgtattcgcaggatgaaggcggaagaggattggatggtgaagaatcttcctgttgaacctgtggaggaagaagggtatattactattgaaggggaagggaacattgaggataagatacggaatcttttgatgagtgtacgggagcgggtttatatttcctgttcggtgcagattctgcggaagtttgaaggggagacgaagcggctggctgctgcggggaagaaggtggtggttattaccgacggggagtatttcatggatggggctaccgtttatgttaccggagataagggatggcagatcgggctgatcacggattcaaagtatgtattgtctggggaatatggggcggggagtctgaatacctgcctgtattcgggacagaacaattttgtaatggttttcaagacggctttggccaatgagataaaattaattgagatgcgcaaaggagagaatcagagatgaaaaaagaaccatttgtaacgaaagcacagctggatgagattgtgaaagaatttcctacaccttttcacctttatgatgagagggggatacgggagaacgtgaaggccttgaaggaggctttttcatggaacccgggatataaagaatatttcgctgttaaggcgacgccgaatccgtttctcattgatatattgaaagaatacggctgcggatgcgactgctcctcctatacggaactgttgctctctgacgccgtaggaatccgcggggaggatattatgttttcctccaatgatactcctgcagaagagtttattctggcggataaactgggggcaattatcaatctggacgatattacacatattgagtttctggagcagacgatcgggcatattcccgaggtgatcagctgccgttataatccgggcggcctgttcaagatcagcaatgatattatggacaatccgggggattctaaatacggcatgacaacgccccagatgtccgaggcctttcggatcttaaaagaaaaaggagcgaaagagtttgggattcatgcatttctggcgagcaatacagttactaacgagtattatccgatgctggcgaaggtgctttttgaacaggctgtgcggctgcagaaggagaccggcgtgcatatcagatttatcaatctctccggtgggattgggattccttacaaaccagaccaggagccgaatgatatccgtatgatcggggacggcgtgcgcagggtatacgaggaagtacttgttcctgcgggcatgggcgatgtggccatttataccgagctgggacgttatatgatggggccttacggctgtcttgtgacaaaggcaatccatgaaaagcatacccacaaggagtacatcggcgtggatgcatgtgcggtaaaccttatgcgtccggcaatgtacggagcctatcaccatattacggttatggggaaagaagactggccgtgcgaccacaagtatgatgtgacgggttcgctctgcgaaaataatgataagtttgccattgacagaatgcttccggagatcgagatgggagactatctggtgattcacgatacaggggcgcatggattttctatggggtataactacaacgggaagttaaggtcagcggagatccttctgaaggaagacggcactgcccggatgatccgccgtgctgagacaccggcagattattttgctacatttgactgttttgacattggaaaaaaactgatcggaaaatgatcgggaaataaataaaaactattgcaaaatagctcggattatgataatataaaactcggtttggaaagcagacaggcattccagaccggtgagcggatatggcggaatcggcagacgcacaagactcaaaatcttgcgggggtgacttcgtgtgggttcaagtcccactatccgcatataaaataacaccgtagaaaggggcttctgctatattatttggtgaagtgtaaccagaggtgtaattaagatattacaagcgttaatgggtactaaattagttatctaagttatttggatgattattttagtacccattttctgttaagaagttatgaattacacgtttcctcttctgatcctacttacgctaatttaacatattttacattaatgaaacaaatagattcatcctattttatataaattaataccgtgatattatttgacatattaatttacgaaggatgaggtaagcacaatgctggataacaaaataggagataacataagagcgttaagaaagaaaaatgggcttctgcaaaaaaatcttgctgatcagctcaacataacgcggcaagcgctgtcaaactacgaagttggaaaacggatacctgacatttttgaattgataaggatggccgaaatttttaaagtaagcgttgatgaaataataggaagggaagtataataagcaactaaaattagttgcatacttagagcgattgcagtataatatgggttggctggacgcggtagccttgaaggcaagtgttagataaaagagaagacgcaacgcagtatcgggctatagcaaaattgatagaggatagaatgaagtgagtaatttattatcatacaagaattataatggcacggttgaatattcaaaggaagacaactgcctatatggaaaagtggtcggcctgaaatcgcatctatcctatgcaggcgactccatccgggaattggaagcggatttccaaaaggtgctggatgaatatctgaaggactgtgaggagcgtgccgcacagccggaacagccatacaaaggaacctttaatgtacggatcagctcggatctgcatagagctattgcgatatacgcaattgagcatgataaaagtttaaatgccgcggtagaagaagctattcaacgtatggttgagctccgagagagaaatattcaatgtccgtagaagaaatgatttcttataaatgcgtattaacagaaaaaagtaagattctggaaaaacgcaaaggaatgttgcgaaagattgcggcgttcctttttcttatgtaaactttatacttgcgtgaatacattttgtggtgcagaaagaaaggtacggggaaagtggaaatggagtattgcattaggattttgggacgcggtgccaggagaaaaagaggtgttagtattcttggggtgttgaccgcaattctattgacagtaggacagattgatgtacttacagctttaaaatcaacagataatgataatgtgtataaccatatttatgataaagatatgggaagagaattgcattcttttggagaaagtccgaatgaatcaggcgttttagatatttttagtacactgatggtaaaaatatctgtgaaggcagatatttctaatatggtggatgcaaacagaaaggcaggagcagaaacttcgcattcggaagaaacaggttttctgtccgatatacttatatcaggcatggaaattccggttatgacagggtcttcggggaatgaacttcctgacctaagtgatataaaggttcgtattccagagatgccgacggaaaattttaccccgccggtgatcccgaatattccgacggttaatgagaaaccctcggttccggagacaccggccgtgccggataagccaatcataccagatgaaccaatcgtggcggatacgccagcagtgccggatacgcccattgtaccggataatccgccgattgatgataatccggcagaacctccggatgtggtcattccggataacccggttgtaccgggagaaaaagaggatccggacagcggtgcggagactccgggtattgaacagccgatcggttttaccgtgaatgaggaggggatgatctgtggtttcgatccctcagcaggagtggtaaacgatggacgcctagttctcccctctgaaaactgtacaggtcttgcaagcggaactttcgagggagtcagttcggagatctatgaactcttcattccacccaatattgtcagcatcgaacccggcgctctgggtgagatgtcagatctggaatggattgaccttacggagcctaatcaaaattatgtttgttcggatggcatgctgtttgacagcagtatgacaacccttctcgtatttccgagaggaagaatcggtacatattcgctcccgtcttatgtgacgagactggaagattattcgttcttaaataccgggctgacaaaaatagatatgatgaaatgcggtgctgtcgaagtcggaagcaatgtctttggcgcaaatggcggaaatggaattataattatggcgccgagaaataatctggagcattatcagaatgttttcgatggtcttggtgtgacgatactgtaaaagcggtagtcctctatgtttataggcagtttacctagtgaaatgaaccggcttgagtcagccggttcaaaaggttaattcattgtataaattgagaaatttaaaaatgccgcgaatatgcaccacagcagataggggatttgcagataagctgcggcaggatttattttatagaaatctttaatcataatacagatcagaacaattaagataacgagccacaaaaaggaaagcaggtataaattatatcgaaagaagagaatactccagcagaaattaaagaaaagctgaagggcgtatatcttcaaagccttggttttatccgcgctgtccgaagaatatatgatgtaagatgatatccccatcagaacataaagaattgtccagacaataggaaaaacaatagaagggggactgaacgccggtttgtttatcgttgagtatagggccatatttccactgataagtgcagataatgagccgacggccagtggaatcagaatggcaataataagtgaacttcgattttgcggtttcatatagagcacacactcctggatttgttatactaaatatatgctgcagtgtcatgcattataactttaatcttatgctgcagaactatccactgacagtattccagggaattattctgggagcgcattcttgcagtacatcagagtatcatcagcggtaagtagttaagccgcaaaaggagattagttgtagcagttcaggtttgcctgaaccgttacgattagttgtctaaaatctgctaaagagtcatctaaggtagaaggtattccggtttcatgataaaatataaattaacaaatctagaagagagtgatataagtgtataatacagcaatttacccgggaacattcgatccatttacaaacggccacttagatatcgtgaaaaaatccgcgaagatatttaatgaggtatacgttgtgatcggaatcaataacaagaagacacgcacatacgatatttatgatatgagacaggcggtagaagagacgttagtggagcacaggctgaataactgtaaagttatcatatataatggcctcatcggacagtttacgcaggataacaatatcggctatatggtccgcgggctaaggaataacatggattatttttatgaagagaacatagcagaagtgaataagctgattaaccctgagattgaatatgtctatttcagagccgataatgtggcgctttcttcgtccatggtaaaagagctgaacggatacggacaggatgtttcaaaatatgttccggagcctgtgttcagggtgatgaaacgatatggagagcaggctggacaggagaaggaccggcctacaaaaccacttttatagtgaagcggtcttcctcgacggcagccgaaacctggccgtccagtttctctgttagtgttttcacgacagccaggccaagccccgtgctttcattatgacgtgacttatcgccggtataaaatctatcgaacatccgtcgggcatcgaaatctggggcattctgtatggtattctgaaagcagattactgccttgccgtctgcctcctgcataagctgaattctgaccgtgctcagggaatagcagacagcattagtcagcaggttctgcaaaatgcgttcaatcatgttccggtcagagtagatgaatactgagctgccgggcagcaggatgtcgggacagatgttttggctgtcaaacagcgggacatgatcggtaagaaaatcgatcagaagattagaaaggtttagctgttccctctttggaacggcctgttcagaatccagaagggtcagatcataaaacgtgctgattagttctttcatccgttccgctttgtgcagcgcggccgtaacccgccgactttgttccccggttagtgcagatgcctgaagcagctgcagatgtccggtaatgactgtcagcggcgtgcgcagatcatgggagatattcgcaatagactctttcggatgctcctcatgctggagggcacaggctaccgtgtaacgctgtttcgtatagtactggttgagggcggcggcgagccgttcaagatcccggtcaatcagtgcaatatccagcattttttcagtggaaccatggacaagagcgtcaatctgatccgctagatttctgatctgcttcttcagcataaggtgccgtctccataaaagtataagcaaaactaagagcaaaatgataatccctatgataacagacacctccccattttatttgagcactctatttcaaatcacatttacaaaatatacgccaggagcagagtcccagtacgattccccaggttccggcaaccatgaagcacccggggaaaaacagcttttgcatactcagtgcttcccggatctgaaaggtcggcaggaagaagaccggcagttttagcatcaacccatatcccaggtataaagcgagtacaaatgttacgattgctgtgacggtaacagcagtcccagtgcttctgaaacagcagcagacaaatatggcgataaaaaagaatccgctgtttaagaaaactgaatagaaaattgcctttcctacattgtataggaatatctgcgtatctgcaattccaaaccgcgaaaattcacgaatacagccggatactggatatacgattgccataaaattaaatgcggccagataagacaggaccttactgaggaaaacgcggcttttcgcgtgtcctgcactcacctcctggctgactgtgcgccaggaaaactcctgccccagaatcagcgccagaatacaggagataagaattagcaggaatgcagaatcgtataccattccattaaaaatatctgtaagggattcggctgcgcctccggcaggccccattacttcgggcacataggtttctgcggtgaagaatcccagtaaaaaaacgccaagtaagccggccaggtacagtcggttatgcagaaattgatacctttccatttttattaaattactcatatagtatgcgccaccctaatccagatcggaatgacagaagctgctatacgcagctgcgtagagcagggcagtccacagcaagtcaataccgatcaatataagttttgaaacgggcaggtcgttcagtgccaaaaggcgaagctgccccattgggagaaaaaccgcggtttttcggactgaatcgccatttaataaaaagatcatgatcaagtaaagcactataggaacgcccagtgtccgcccgatatccctgaagataaagccacagacaagcggcagcattcccatggcaattagagcagcaaatagcagggcagcgtcagaaaaaattgtgccaatacgatccagctgccattcccagtaaggattccaagcaccaagtggattaccaggggcagccctaggatcagcagtccggcggcctgataggcagctgtcttggcaaataggacagaactgcgcttatgacccgcgctgacaaagctgtgcagggtctgctctgcaaagtcagcccccacaaagagagagccaaacacaatagacagaaagtaaagcaatggggtattaaatagcgaggcgttcaccagtccgtccgtaattgctatgctgtcaagcagtagaacacttcccaacaacagcgaaaaaagagtgatcccccaaaaactccggctgcggctcagcttgtaaaattcggctttcaacagatcagtcatggggaacccctcccaccttgctcagaaaataatcctccagtgtatcaccggccaggttcaatccggttaccagaatatgagcttccgataaaatctgcgcaactttttctatttcatccagataatcatacaagcggatcgtaccgtcaggcataagctggacccgatccgtatgcagtcgttcttccagcaccagcagcgtcttttccgaatcaccggttcggatggcgatatggcgtctgcaccgctcatccagttcccggtccgataattcctcaataattctgcctttatcaatcaggataaattcggcagcggtctgatataactcttccagaatatggctggataccagaatcgtcatgccatactctctattcagagactttaaaagatttctgatttccacgatccctgcgggatccaggccgttgatcggttcatccagaatcagaaattcaggcatattcaaaagtgccgctgcaatgcccaggcgctgccgcatgcccagagaaaagttccggacacttttattaccggtatcgggcaatccagccatttgcagggagcgggcaatgacagactgatcagggatgcctctctgaatgcgctggagttccagattctgcgcggcggtcatgccgggaaatagtgcaggagtctcgatcatacatccgatccgtttcctctgtttctgcagctgtgctgtagtggaatggccccacagcgacaaggtgccgccggagggaaatgccagcccggtgatcagccggagcagtgttgtttttccggctccgttctgtccgataaacccatagatctttcccttttcgagtttcaggtaaatatggtccagtgcatttgaatgccgatatgtcttcgtaagatcctgggtttctaaaatagttgaattcattctgtcgacctcctttatgatatgagtctaaaccggaaatataaagaattccttaaatggaaaagaaaagcataaagaatcaataaaggggaaagaaacataaagccaaggactttagcccctggctttatgcagtcggtacccgattccccagaccgtatctatatattcctcatccgggcagactgccttcagtttgccgcgcagattactgatgtgcacattcagcgtattgtcttcactgaggtattcttctccccatacgctctgaaataaatttgcttttgagaagaccttgtccggatacctcatcagtaattccagaatggcagattctttcgccgtcaacaacagctcctgttttttcaggcgggccgtttttttatcaacatctaaaataagattttggtattccagccggctgcagggggcggcctgatattgtacccggcgcaggctgctttcgatccgggccagcatttcttccatatcgaaaggttttgtgatgtaatcgtcggcgcccagacgaagcaggtctatcttattctgagtcgtctcccttgcagatatcacaattacgggaaccgtgtactgctttcggatgtctgcgagaagcagatcaccgcttcggtagggaagcatgagatccagcaagatcaaatccaccttatgctctttcagacagtccagcacatgtaaaccatcgtaccggctggtaacgatgtatccgtttttggctaaaaaatcagataaaagtttgttgatttcatcatcatcttctacaattaaaatatgatacacgcttttccacctcttttttaattcgatataaggatactatattatcgcattgaacccaattgctggcagcaagttactgttcacaccctatgggtttgcacagtatcggcagtaagacttatgctatcttgttttgccaactacattgacatcaaccggaaaagactttatagtatgtagtgaatataactgacatgataagctattttacaggatgtttcaagagagaatgtacaaaatgcagctgggacgttattgtgtgcgccaacaaggtgtaaatagtaacgctatgacaaacatatacatggaaccaggcaaacctgcggtcagtcccgccgggagcaggttccgtccagaggaggtgaacgatatgacgttcaaacgtggagatacttgttttatactggaggataactcacaggccgtccaggtcaaagttgtaagtaagcaggggaaaacatatatagtgcagctgattggttcttgtggggccttaaaactgccggaggagagactgtttgagacagcagagaaagcgatggcaagcaaaaagacatcacgggcgatggtaagcccccagttatcggattctgatacaaatcccggactgacagagatccggatttcagataaggggaaccggtggcgctgacaggagcggcggcagccatatgtgtacggacaagagaatgtttcctgatttatagtagtaactcttaagaatgaagcagaagaatttaggtactggtgtaatgagagtgtaaggatatcaaatgcaatagctatttagaaaaatttctaaatagctattgcattttttactgccatctgttataaactaattagatggatttctaaatagattccattaaccataaaaatatgtgaaatacgaaaagaaatggggggtgctgatgggatttgcagaaacatttaaggcgctttctgacccggtgcgcagggagatcctggttctgctgaaggacggcagcatggcggcaggagagataggaagccattttgatatgacaggggcaacgatttcctatcatctgggcgtgctgaaaagagcggatcttgtatgcgaaacgaaagtgaaaaattatatttattacgaactgaacacatctgtagtagaggaacttatgttgtggctgtcagacctgaaaggagacaaataaaatgaaagtatatttaaaaagaataataatcaccagtgtgatcacggttctgccgatgctgatggggattctgctctggaataaaatgccggatacaattgcgacacactgggggagcggtaacgaagccaatggctggagcagcaagccttttgctgtgtttggcatgcctcttattctgaccctgctccatctcatatgtgtaggtataacactgaacgatccaaagaagaaaaatatcagccagaagatgctgtctttgatcttctggatcatcccggttgtttcatggctggtatgtgccataatgtatggcacagccgccggaatgaaggtaaatatcggtatggttacaaatattatcatagggattctgtttatggtagtgggtaattatattccaaaaagtaaacagagttatacagtggggatcaaactgccttggacgctggcgagcacagaaaactggaacaaaaccagccgactggcaggaaaattatggatcgtgggcggcatcctttttatcataaatgctttccttctgtacagcggcgtactgtttattgtgattttactgatggctgttataccagcagtatactcattttgtctttataaaaaagggatctagcactgcattgtgtaattagcaggtgttttttcactgttaattgcgcaaggcagtactagcgtgcccgttttgtaggacagtatatttactgagaaaacgcaaatgaaaataacatcatataaatttacttgaaaaaaaattaaattcggcattgacatttgaaggaggaagtgtatataatatacaataatttaataatgtaaaccgatgaagcggagataaaaacatatcgtgcattcacagagagcctgaggcggtgggattcaggtaaacgcagtttgttaaatggaccgcagagggcatgagggaaaggccgtgaggccgagtatagcatgacgtatgggcgtacgtcagtcgccggagatatgatagtatcttgctaagggcacaggatttattttctgtgaatcaaggtggcaccgcgaattgaattttcaatccgtccttgacattactctataattgtaatgtcagggggcggatttttttttgtttcataggatagtgccttacacttttctgtgaaacaaaaagcccttctggcgggatgcgcattgcagcataagaggcagatgctgcggagcggacaacgcaggtgtaactatattgagaatattctgaaaatggaccgcataggggtcagacccctatgaaagcccccctatgaaaggagaacttatgacttatccagatttgaaaacggcagaagagttggcagcgatgggaatgtatcatacgatgcctgtcagtatggagatgttttctgacatgtataccccgatcggggttttgaggaaattgaaaaatgtcagtgaacattgttatatgctcgagagtgcggaggatgcaaaacgatgggggcgttacagttttctgggatttgaacctactatggagatcagctgcagaaatgggatgcttcacatgaaagacagtgaggtcagggaagtggagacggcatgccccggggactacatacggcaggtggtggaggagcacagggcgccggagatcgcgggaatgccttcctttaccggcgggcttgtcggatatttctcatacgattatatcaagtatgtggagccttcactgaagctggacgccagggatgagtcgcatttccgggatctggatctgatgctttttgatcaggtaattgtatttgacaatctgaagcagaagatgattttgatcgtaaacatgtctttagataaagatgtgaaaaaagagtatgaagatgcagttgcgagattgatgcggctggaagcaattgtgcaggacggtgaactggagccgcacattccactgatagtaaaaaatgggtttcagccgcattttacaaaagaaaaatactgccgcatggtagaagaggcgaaacatcatatctatgagggcgatattttccaagtggtattgtccaatagactggaggcggagatggaagggagcatcctggatgtttaccgggtgctcaggagtacaaatccttccccctatatgttttatttttccagcaatgacattgagatcgccggcgcctccccggagacgctggtgaagctggaaaatgggacgctgcacacatttccgctggcgggaacccggaaaagaggggatatctgtgcggaggacgaaaagctggaggcggaactgcttgcggatgaaaaggagcttgccgagcataacatgctggttgacctggggagaaatgatattggaaaaatcagtaagatcggcacggtggagctggaaaaatataagagtatcgagaagttttcccacgtcatgcatattggttcaacggtgaagggggatatacgggaggataaagattttatggatactgtggatgcgatactgccggcgggaacgctatccggggctcctaagatcagggcctgccagatcatagatgaactggaggactgcaaacgcggcatctacggcggtgcagttggctacattgattttaccggaaatctggatacctgtattgcaatcagaatggcctacgctaagaatggatcgctctatgtatgctccggagcaggtatcgtagctgacagcgtgccggaaatggagtatcaggaatgtatcaacaaggcaaaagcggtgacaaacgcagtggaaagagcaggagaggggatgggagcatgattttgctgattgataattacgacagtttttcatataacctgtatcagctgattggggcagagtgtgaggatctgaccgtcatacggaacgacgaaaagacggtggaagagatccgggaaatgaatccggcctgcattgtcctttctcccggtccgggcaggccggaagatgcgggggtgtgtacggaggtggttgataagctggcaaaagagattccgattctcggtgtatgcctgggacaccaggcgatctgccaggcatttggcggaaaagtgacatatgccagacaactgatgcatgggaagacctcaagcatcgagcttgactgcagcagccggttatttcaggggctggaaaaaagcattccggccgccagatatcattcactggcagcggaggaagaaagccttccggatgtgctcagggtaaccgggagggcagcagacggagaaatcatggctgtagaacacagagagtatccggtctatggcctgcagtttcatccggaatctatcctgacgcctgacggggcgcaaatgatccggaattttttgaaaacaggcaaagcgcaacagtagaccagacatattaaataagagcagcagggcagaaaggaaacaggacatcatgattaaagaagcaattttaaaactggcaggaagagaaaacttaacctatacggaagcttatcaggtaatggatgaaattatgagcggggaggcgagcaatgtacagatgagctcgtatctgacggccatgagcctgaagggggagaccattgacgagatcacggcttcggctgcagggatgcgggagcactgtgtgaaactcctgcataatgtagatgcgctggaaatcgtagggacaggaggggatggagcaaattcgtttaacatctcaacaacctctgcacttgtgattgcggcagcaggcgtccctgtggcaaagcacggaaacagagccgcatccagcagatgtggggcggcggatgtactggaggcactgggggtgaggatcacgattccccctgaaaaaagtgccgagctgctggaaaagatcggaatctgttttctatttgcacaaaattatcacatcgccatgaaatacgtagccccggtcagaaaagaactggggatcagaaccattttcaatatcctgggaccgctcgctaatccggcaggcgcaaatatggaagtcatgggtgtctacgaggaggctcttgtggagccgcttgcaagagttcttgaaaagctgggagtcaaaaatgccatggtcgtgtacgggcaggataagctggatgagatctcaatgagcgcgccgacgaccgtatgtgagattaaaaacggagagtttcattcgtatacggtcacgccggagcagtttggttttacatcctgcggcaaaaatgagctgcagggcggaaccccgcaggaaaacgctgagattacgaaagcggttctgagcggcagggaacttgggccaaaacgcagcgcggtactgctcaatgccggtgcagctctatatgtggcaggcagggcggatacacttgaagcaggggtaaagatggcgcaggaagctatagacagcggcaaggcacaggaaaagttagaacagttcattgcgtattcaaatgaagaaatataaggcgggtaaacaatgatattagaagaaattgcagacagaaccagagagagaattcaagaaagaaaacgggaagtacccgagagagaattaaaggaaagagcatctggaatcgcagcggcagaaaaagaaaaaaacggaggtaaatttcgctttccttttgaagaagcattaagacaagaaggaatgtcttttatctgcgaagtaaaaaaagcgtctccgtcaaaaggggtaatagcggaacattttccctatctggccgttgcagaagattacgagagcgcgggcgcggcggcaatatctgttttaactgagccatactattttcagggcagtaaccgatatctggaggaaattgcggaaaaagtgcatatccccatacttcggaaagatttcaccatagatgcctacatgctctttgaggcaaaatgcatccatgcgtcggctgtactgctgatctgtgcgattctggaagagcaggaactgcgcggatatatgaagattgcagacgaactggggctgtcggcattggtcgaagcacacaccgaagaagaagtaaagaaggccctgcggtgcggcgccagaataataggggtcaataatcgggatttaagaacctttcaggtagatatccggaccagcagccggctgcgcgccctggtgccggacgggatactctttgtatccgagagtggaataaaaacagccggggatgtccagtgcctgagagaaaacggaacagatggagtactgataggcgagacgcttatgcgatttgtcaacaaaggggtcagacccctttgcccaccattgtcagaatattttcaagatttatcatccggggaggggatatgaagattaaaatatgtggtttgtgcagggaggaagagattgcggctgtcaatgaagtgcagcctgactatattggatttgtctttgcgcagggcagcagaagatatgtagatccaagacaggcggcccttttgaggcaagggttgtctaagaaaatagccgcagcgggggtgtttacagatgcgccgctggagcagattctgcagctggtatacgaaaaggtgattgatatcgtgcagctgcatggaaatgaaactttggaatttgcggaagatttgaagtgctgctgtgatgtcccggttgtgaaagcagtttctatgtcaggagatacgtacagcagagagataaagaggtgggagcacagctgtgtggattatctgcttttggacagcggcaggggaggaacgggcacaacttttgattatggaagaatcggcagccctgccaagcctttctttctggccggggggctgactccggaaaatgtggcggaggcggcccggcaggtattgccttacgcagtcgatatgagcagcggtgtagagacagacggcaggaaggataaagaaaaaatagaaaaagcagtcaggaggattcgagatgtcgaaaggaagatacggtgagtttggagggcagtatatctccgaaacattaatgaacgagttgattcagctggaggaacaatatgaatattataaaaaagatgcaggattccagcaggagctgaaacaattgtttaatgaatacgcggggcgtccgtccctgctgtattatgcagaaaagatgacagaggatctgggcggggccagaatctatcttaagagggaagatctgaatcatactggttcccacaagattaataacgtgctggggcaggttctgctggcaaagaaaatgggaaaggcaagggtgattgcagaaacgggtgccgggcagcatggtgtggcaactgcgacagcggcggcgcttctggggatggaatgtgaagtctttatgggaaaggaggacacggaccggcaggcgctgaatgtatacaggatggaactgctcggggcaaaggtccatgcagtaacgaccggcacacagaccctgaaagatgcagtaaatgcgaccatgcgcgaatggacgaaccgggtatcggatacccactatgtacttggctccgtgatggggccccacccgttcccgatgatggtgcgggatttccagagtgtgatcagccaggaggcacggcagcagatcctggaagcggaagggagacttccctctgcagtgcttgcctgtgtgggaggaggaagtaatgccatgggtatgttttacaactttatcgaagatgaaaatgtaaaactgatcggctgcgaggcggcaggaagaggaatcgacacagaccagcatgctgcaacgatggcaaagggaactctgggagtcttccacggtatgaaatcctatttctgccaggacgaatacggacagatcgctccggtgtactccatttccgccggactggactatccgggcatcgggccggaacacgcatatctgcgggattccggccgcgcagagtatgtgccggtgacagacgatgaggcggtagatgcatttgaatatctggcaaggacagagggcattatctgtgccatagaaagcgcacatgccgttgcacatacaagaaaaattgcaccgcagatgagaaaagacgagagcctgattatctgcctttcaggaagaggcgataaagatgtggcggctatcgcaaggtataagggggtagacattcatgagtagaatagcagatgcatttgcagggggaaaagcgtttatcgtgttcttaacggcaggagatccctcgggggataagacagtagaatacattctggcaatggaagaggccggggcggacctgatagaaatcggaattccattctccgatccgaccgccgaaggtattgtgattcaggaggccaatatcagagcgttgaacggaaatatgacgacggacggtgtgttcgaaattgtaagaaaggtgagaaaaaaaagccagataccgctggttttcatgacttatctaaaccccgtgtttcattatggatacgaagcgttttatacgaaatgtgaggagctgggcgtagacggaattataattccggatctgccctatgaggaaaagggggaaatgtcacatatagcagacaaacacggtgtagatattatttccatgatagcgccgacatccagacagcgcattcagatgattgcaaaagaggcaaagggctttctctatgtcgtatcctccatgggagtaacgggtgtgaggaatcatatcgagacggatatttcatctatgattgcttctatccgcgaagtgaccgatcttccggcagccgtaggtttcggaatcagcacgccggagcaggcaggggcgatggcagcagtatccgacggggcaattgtgggaagcgccattgtaaaattgattgaaacatatggggataaggcggaggaagccttgaaaacgtatgtgtctgagatgagagaggcagtacgcaactgctgaacgcagaatttcggataaaacagatcagggggcagcccggccctgccgtctgagacacaaaaagattcagttggcagagccggatattttagtgacagcggatcacagggagatcaacgggaaactccctggttttcctgcaagcatttcccgttccgcacatttataatagaagaaacagttccagcagctcgctgattctggatattttcacttccgcggcggggacattgccaaagccgtatgatgcgaaaataaaaggaatgccggcttccaggcaggcctcataatcaccctgtgtatcgcccacatagaccacatctctcagttttctgcgctccatcagagttctgatcgtcatccccttagaggtctgggtttcaccaaagcagaggtggtcctgcacagcagctttgagtcctgttgtctttaaaaagacttcaatatatccgcactggcagttgctgacaatgaaaatccgggtgctctgagaaagccttagcagggtctcccggacgccttcatagaggatgccgggtttcgtctcaagaagcttgttttcgtattcgaagcagatatcacccagtttctgctgttcctctttcgacaaagtaggaaagactgcatgatatatctcgtccattgttttgccgaacagattcttcagcatcgggccatctattctgacatccaggtcagaatgttcggcaattgcctggttccaggcctctgccactgagttcgttgagtcccataatgttccgtctacatcaaaaataattccatccattttctatactccttaatcgcaaaaattctgtaacagttcaggcaagcctgaaccgttacgcatccagcctattgaaattcgcctgcagagaaaggctggatgcctgtaaccaacatgttttcgtacggtctgcacagtaaatgcgcagacctatctgaactgttacaaaattcaacagttgctttcataatatcataaaaatagccttttaaaaagaaagaatttagtgtatactctattatgttatagtgaacgttagtaagggacgtgtgtctgcacattttcccaacggcggtcatgatataatatcaccaggatgtggagaaaaaactatgagtaaaaagattgtattaatagatggccacagtattttaaacagggcgttctatggagtaccggacctgaccaattcagaggggcttcatacgaacgctatttatgggtttttgaacatcatgttcaagatcctggacgaggagaagccggaatatctgaccgtgacatttgatgtgcatgcgcctacattccggcatgagatgtatgcagattataagggaaccagaaagccaatggcagaagaactaaggcagcaggtcccggtaatcaaggaagttctgcaggccatgaacatcgagattatcgagcaggcaggcctggaagcggacgatctgctgggaacgatttcacgcatctgcgaggaaaaggggatggatgtcgccatcatatccggggacagagatacgctgcagctcgcgacggagcatgtaaagatccggattccaaagacaaaacaaggcaggacagaagtagaggactattacgcagaagacgtaaaggaaaagtatggagttaccccgacggaatttatcgacgtgaaagcgctgatgggtgatgcatcggataacataccgggcgttccgggagtcggagagaagacggcaaccaagataatcgtggaatatggcaccatagaaaatgcctatgcccacgcagcagagatcaagcctccgagagccagcaagaacctgcaggagtactgggatcaggcgtgcatgagcaagacgctcgccaccatcaatactcatgcagagatcgcgtttaacctggaagcggctgagcatgggaatccgtttacgaaggaagcacatgactattttcagaaactgcagttcaaaaatctgctgagccgttttgatgtagaaagctcatccaataaagtggaatctcatttcaaggagatcacggataaagaggaagcggaaaagatattcatagaggcagcccaggcggagtgtgtaggcgctgcaattacggaggatgccggaaatgtgctgcccctgtttgcacatccgtccggttacggaagagtgagtattgcctatgggccggagcgcatctattccattccctgtgataccaatatggatatagagtatctgtttggaaaattaacggaaatagcaggcagcgtacagacatttgccatgtttgacctgaagaaataccttcctctggtgaaagcggcagagcaggagaaatgtttcgatgccactgtggcagcttatcttctgaatcctctgaagaataattatgattacgaagatgtggcaagggaacagctgggaattatgatcgatgagaaggcagatatcatgacaaaggcatgttatgaagcgtacactgcatttgcatccgtaaaacctttgagagacaagatgcaggcggaggggatgtaccacctgtttacagacatagagatgccgcttgttttcaccctgttcgatatggagcaggcaggtatacaggtggaggcagaggctctgaagttttatggagaacagctgggcggccggatcgtggagctggagaaggaaatctatgagatggcaggggagacctttaacatcaactctccgaaacagctgggaactgtcctttttgaccacatgcagctgcccaacggtaaaaagacaaagaccggatactcaacagccgccgatgtactggagaagctggcgccggattatccggtggtagataagattttggagtacagacagctgaccaagctgaaatccacatatgcggacggcctggctgtctatattggaccggatggaagaatccacggaaagttcaaccagacgatcaccgcaaccggccggatcagcagtacggagccgaaccttcagaacattccggtgcggatggaactggggcgtctgattagaaaagtatttgtaccaaaagagggctgcgtctttatcgatgcagattattcccagatcgagctgaggatactggcgcactgctccggggacgaacagctgatccaggcttataaagaggccagggatatccaccgaatgacggcttcccaggtgttccacactccgtttgaagaggtgacggaactccagcggcgcaatgccaaggcggtcaactttggaatcgtatacggaatcagttcctttgggctgagccaggatttgagtatcaccaggaaagaagcggcgcagtacattgaaaattattttgagacttatccggggatcaaacgttttctggatgatacagtggcccatgcaaaaacggagggctacgttgtaactctcttcgggcgcagaaggccggtgccggaactgaaatccagcaattttatgcagcggaatttcggagagcgggtggcgatgaacgctccgatccagggatctgccgcggatattatgaaaattgcgatgatcggtgtaaaccgggagctgaaggaaaaaggactccggtcaaaaatgatcctgcaggtgcacgatgaattgctgctcgaggcccacaaggacgaagtcgaagaagtaaaggagatactgaaacggcagatggagcaggccgcagacctggacgttcccttgattgtagacatgcatacaggggaaaactggtacgaggcaaagtagtgtccgtggcaaagcggagtttggaaaaatttgagtaaagcgaatattgacaaagaggaatttagatgaagatactgggaattaccggcggggtaggttccggaaagagtaaagtcctgcatttccttgaggacgaatacggcgcggtggtctgccagctggatgaggtggccaaagagcttcagaaaaagggcggggtctgctatcagaagatcatagagctgttcggtacagagatcatagggacggacggggagctggaccgcagccggctggccgccctgatttttcaggatgtaaagatgcggcagaagttgaacgggattgtccatccggaagtgaaaaaatgggtggaacaggatatcgaggaaaagaaaaaacggaaagtgccgctgtatgtgatagaagcggcacttcttccggaggcaggatatgaagacatctgcggggaaatgtggtatatttatgcaaaagaaagcgttagaagagaacgcctgaagcagtccagagggtattccgatgagaagattgcccggatgatggaagcacagtccccggaacggatatttcgcagcgcatgccaggctgtcatagataacagtggggcatttgacaatacaaaaaggcaaataggagaaatattatgaggttatgcagcattgccagcggaagcagcggcaactgtatctatgtggggagcgacaacacgcatctgcttgtggatacaggaatcagcaagaaaaagattgatgcagggctaaaagagttggacatcaaaggagaagaactggatggtattttgatcacacatgagcattcagaccatattcagggactgggcgttttcagccggaaatatgaggtgccgatctacgcgactccgggaacaatagaggggattgagaattatgcgcccctgggaaggatgccggaagggcttctgcatccaatacatacggacgaaagttttatactgggggatattaaaattgatccgtttcggatctcgcatgatgcgaaagagccatccggataccgtatgaactgctgcgggaaatccgtggcagtggcgacggaccttggaatttatgatgaatacacggtgtcgaagcttaaaagtctggacgcggtgctgctggaggcaaaccacgatatccatatgctggaagtaggatcctatccatattatctgaaacggagagtcatgggagacaagggacatttatccaacgaagtgtcaggaagacttctttgtgatatactacatgataatttgaaacacattctgctgggacacttaagcaaggaaaataattatgctaagctggcgtatgaaaccgtaaagctggaggtgactctgagcgataatatttataaaggtgaggatcttgacatggctgtggcaagaagagacatgatatcagagatcattacagtatagacaatgaggaggataagaagatgaaaaaatgtatcgtaacagtgctggggcaggacaccgtagggattatagcaaaggtttgtacatatttggccgagaacaggattaatatactggatatttcacagaccattatccaggggtattttaatatgatgatgatcgtggatgtaaccagtcttgacaaagactttaaagtagtctgcgatgaacttgataagctgggtgaagagattggagtgaatatccgctgccagagagaagagatattcgaaaagatgcacaggctgtaagaggagagcgtgaggatagaaggcgaggataagcactatgattaatatgtatgaagtatcagaaaccaataaaatgattgagcacgagaatctggatgtccgtacaataacgctggggatcagtctcctggactgtattgactctaacctggaggaactcaaccgcaagatttatgataagattacgaccgtagcggcaaaactggtttctaccggaagtgatattgaaaaagaattcggaattccgattgtaaataagagaatttctatcacacctattgctttggtgggaggggctgcgtgcaagtccccggaggattttgtgacgattgcaagaactctggacagggcggcgaaggaagtcggcgtcaattttatcggcggttattccgccctggtttcaaaggctatgacaaagagcgatgagaacctgattcgttccatcccccaggcactagctgagacggagagaatctgcagttccgtcaatgtgggatccacgaagacggggatcaatatggatgccgtgcgcttgtgcggtgagatcgtcaaagccaccgctgaggcaacaaaagacaatgattccctgggctgtgcaaagctcgtgatcttctgcaatgcgccggatgataacccgtttatggcgggagcattcttaggagtcaccgaggcggatgcggtaatcaatgtaggagtcagcggaccgggcgtggtaaaaaaggcgctcgagaaagtgcggggcaagggctttgaggagctctgcgagaccatcaagaagacggcgttcaaggtaacccgcgtgggacagcttgtagccggtgaggcctcaaacaggctgggaattcccttcggtatcgtagacctgtcactggcgccgactccggcggtgggagacagtgtggcagagatactggaagagatcggactggagcgcgtgggagcgccggggacaacggctgctctggcaatgcttaatgaccaggtgaaaaagggcggcgtcatggcatcttcctatgtggggggcctaagcggtgcgtttatcccggtcagtgaagaccagggaatgatcgatgcagtcaacgccggttccctgacgctcgaaaaactggaggcaatgacctgcgtatgttccgtaggcctggatatgatagcgattccgggtaagaccagcgccagcacaatatccggaatcattgcggacgagatggcgatcggcatggtgaaccagaagacaacagcagtgcgtctgattccggtgatcggaaaggacgtgggagaaacagcagaattcggaggcctgctcgggtatgcgccgattatgccggtcaaccagttcggttgtgaggcatttgtcgggcgaaagggaagaatcccggctccaattcacagcttcaaaaactaaaacaggggaaatatatatgaagaagattgcaattgtaacggacagtaacagcggaatcactcagaaagaaggaagagagatgggcatctctgtggtgcctatgccgtttttcattgatggagagctttttctggaggatatcacactgtcacaggaagagttttacaaaaaactgggagaggattccgatatttcgacctcccagccgtcacccggagagattctggaactttgggacaaactgctcgaggaatatgacgaagtcgtgcacatcccaatgtccagcgggctgagcagcagctgcgagaccgccatcacgctttcggaggactatgacggcagggtacaggtcgtggataaccagagaatttctgtcacccaggtgcagtctgttctggatgcgataaagctgaggaatgaaggaaaatccgcagaagagatcagagagattctggaaaaagaaaaaatggaagccagcatctatatcacagtagatacgctgaaatatctgaaaaaaggcggcagaattacccctgcggccgcggctctgggcaccgtgctcaatttaaagcccgtcctgcagattcagggtgagaagttggatgcatacgcaaaagtgcgcggctggaaagctgcaaagcgcaccatgctgagtgcagtcgagaaagacctcaaagaaagatttgccggccatgaagatcagatggtcctgggtatggcatacacttgcggacaggaagaggcgcaggaatggaaacaagaaatccaggaaaaatttccggggtatcagatcatagaggggccgctgtcactcagcgtagcgtgccacataggccccggcgccatggcggttacctgtatgaagcgagtgtgagggggagatccgctccggggaatgtgtgccgggatgttccgggggatgcacatgccggttgggaatgcggcccgcttattaagggattctaaaaggaagaaggcagaaaatacggacacggcctgacacatcacgggaaatctgatgatttcccgcgctgggtcagccaaaaacatgattcggaatcatgtttttgtccgtattttctgccttcttcctttaagaatccctaaatgcgctctacgcatccccaaccggcatgtgcatcccccggaacatcccggcacacattccccgtcgctggacgcatccaggcgggagggaaaacggggacgagataggaatggggatggaagatggggagctgcgcgaaaccacgaaaatacgccttcccgcctgttcctcatcggcgcggcccccctacaccttaataaccccctgccgatactcattagaaaatgccgttttgaatttatccgtgatgacggatgtataaaggtttgaggcgagtatatcgtgatagagcattttctgcccgatttcagggatatcatcagtctcatagaggctggtcagcagcggcagtgttccacttttgactacactgcccaggattttttcgcggtctttgcggtaacccagaagacgggcatagtagtgataacctccctcgatatattcttccacactgtcctttttgatgcccagcatgatgtgaagaagggcgcggttgatgcgggtctgggtgatttcttttgtcttaagcagctcgcagaactgtttgtagttgaaaaagttattgagctgattgatgatacggttggcaagttccacggatacgtccatgtaacggctcaggtcgttggccgttttattcagaagtttgtacttcatgataagggaaaagtcattctggtagaccggatattttacgcggtggtagtcttttaacagctcaagacagctggagggcacttggtcttccagctcatttaatatgttggaaaaaggcgtgttttcaaacgtgctgcctacggatcgggtgctgatagcggagctggagtaggccaggagggaacggatggcggatgcggagctgtagctggaattaagttttctgtcgtggtagtttgattccattcttttgatggtatatgggcgaatcgtgctgttcagctttttgagtgcctttaggtattcgactccaagaatgttgttcggatcgttgagcaggaaggtatagtccgtgctgcccatataggcggccagggcctcctgcctggcggcagggaaagtatggccgttctttaaaccgttctgcagaaggcttttgtattcctcgggctcctcatataagatgtccgcaattttttgaagcccatccaggtcattgcattcgctgccgaaacagatggagtctacgattcccaggctgtccagaaaggatacggcgcccatggcgaataattcggcgcttcctgtggaatagcagaccggcagctcgaagacggcaccgacgccgcattttaaagccatttctgcgcgtatgtatttgggcatgatggccggggtgcctctctggacgtaatctccggtcatgatggcaatggcggtgtcggcgccggtgacttccttcgctttttctatatggtattgatgtccgttgtgaaacggattgtattctgtgattaaaccgacaattttcataagattctccttgtatatcaatttattaaccattatactataaaatgacaggatgttataggctgaaatgtgtttattaaggttgatttctgttaaatataagtaagtacagagactttttagaataatgtagctgttcatggttcagaacagatacgaataaaacaggacaaaagagggtgtatggcatggaaaaaacgaagattgaagagcttctggaacagcgcagatttaaggaattgaaagaagaattagaagccatacatccagtcgatatcgtggagatgctggaggattttgacagaaagcaggcactcctgattttccggcttctggccaaggaggaggcggcagaggtctttacggacatgaacagcgatatgcgtgaggatctgatcaatgcccttacggactccgagctggaagaagttatggacgagatgtatgtggacgataccgtggatgttctggaggagatgcctgccaatgtggtggaccgtctgcttatggccacggatgaagatacaaggaagaagattaatgtgctgctgcagtatccggaggacagtgcgggcagtatcatgaatgtggattacatcagcctgagaaaagagatgacagtggcggatgctatcctgaagatccgccaggtcggcattaataaggaaacgatttatacctgctatgtgacggaaaagaagcggctgatcggcgcggtggatgtcaaggatctgctgacggccggggacgcctggctgatcgaggagatcatggatgagaatgtgctttgcgccaagacgctggacgaccaggaggatgtggcggttacgatcaagaagtatggattgatagcgattcccattatagaccatgaaaactgtctggtcgggattgttacggttgacgacgcgatgtttgtcctgcaggatgagacaaccgaggatatcagtatcatggccggtgtcagcccaaatgaagattcttattttggaacttcggtgttccggcatgcaaagaacaggagcctctggctgatgcttttgatgctttccgccacagtgacaggggaaatcctcggattctatgaggaggcaatggcggtgatgccggttctgattacgtttatccccatgctcatggggacgggaggtaactgtggttcccagagttccaccctggtgatccgcgggctggccgtgggtgagatacagttcaaagacattttccgcgttatatttaaagagatccgtgtggcgcttgtggtcagtgttctgctggcggtggtgaatggcatccgcatttatatcatgtatggacagaacatcacattggcaatagcgcttggtattacgatgatggcggtcgttgtcatggcgaaatgcatcggctgcacgctgcctctgctggcgaagaagctggggctggacccggcgatcatggcggctccgctgataaccacgatcctcgatacatgcacaattctggtttactttaatatcgttacggctatctttcacctgaatgcctgatatagcggtaagaatcggtttaataggggattgtatttaaaaatacacatagtatatacttgtatacaaaaattctttgggttataatggaaagagtgagaaaaaatgaaaggtggcttttaaatcatgggatttattgacgaaatcaaggcaagagcgaaagctgataagaaaacaatcgtacttccggagacggaagatgtcaggacttaccaggctgcggaagcggttctgaaggaggggacagccaatctgatcctcgtgggcagtaaagaggaagttgagaaaaacggggcaggatatgatgtctccggtgctgtaattgtagaccctgcaacgagtgaaaagacagaggcttacattgcaaaattagtagaactcaggcagaaaaagggtatgacggaagatcaggccagagaactgcttctgaataattatctgtattacggtgttatgatggtgaagatgggggatgcggacggcatggtatccggcgcatgccactcaacggcggacacgcttcgtccatgtctgcagattctgaagactaagccgggtacaaagcttgtttctgcatttttcctgatggtggtaccggactgcgatatgggagcggacggaacatttatttttggggattcagggctggaacagaacccggatccggagaagcttgccaacattgcggtttcatccgcagattctttccgcacgctgacagggaaagaaccgatcgtagccatgctgtcacattccacaaagggaagcgcaaagcatgcggatgttgacaaagtagtagaggcaacaaagattgccaaagaactggcgccggaactgaagctggacggagagttacagctggatgctgctatcgtgccgtcagtaggggaatccaaggctccgggtagcccggttgcaggacatgccaacgtattgattttcccggatctggatgcggggaacatcggatataagctggtacagaggctggcgaaagcagaagcttacggaccgctcacacaggggatcgcggctcctgtcaatgatttgtcacgcggatgcagtgccgaggatatagagggtgttgtagcgattacggcagtgcaggctcaggcacagtaaacagttcgtaatagttcggacaggcctgcgcataccgtacgaaacatggtggttgcaggcatccagtctttgctctgcttcggtccgtgctaaacgtgcgccactggagcacagcacccttcgccgcaggcggatttcaatgggctggatgcgtaacagttgtgtgtaagagaggcggagaacgccccttatatagaaattcaggaggataataaaatgaatgtattagtaatcaactgcggaagttcttctctgaaattccagttaatcgactctgaatcagagaaggtgctggcaaaaggcctctgcgagaggatcggaatcgacggcagccttacctatcagccggagggcggagagaaagtaaagtcggaaaaagacatgcctacccatacagaggcaatcaagtacgtaatcgacgcgttgacagattccgagacaggcgttgttaagagcctggacgagatcggcgctgtaggacaccgtatggtgcacggaggagagaagtttgcctcttctgtagtgatcacagaagaagtgaagaaggcagtagaggagtgtaacgacctggcgccgttacataacccggcaaacctgattggcgtgaatgcatgtgaggagttgatgccgaatactcctatggttggtgtattcgatacggcgttccaccagactatgcctgaaaaagcatatatgtacggacttccttatgcatactatgacaaatataaagtaagacgctacggcttccacgggacaagccatagctttgtatccaaacgggcagcggagatttcaggtaagccttatgacgccgtgaagacgatcgtctgccaccttggaaacggtgcaagcgtgtgtgccgtattaaacggcaagtccgtagacacatccatgggactgactccgcttgaagggctggttatgggaacacgttctggagatattgatccggcgatcatggaatttatagcaaagaaagaaaatctggatatcgaaggcctgatgaaagtcctgaataaggattccggcgtatacggtttgtcagggctgtccagcgatttcagggacctgtcctctgcagctgcggaaggaaacaaacaggcgcagatcgccctgaaagtattttcatacagagtggctaaatatgtcggaagctatgcagcagctatgaacggcgtggataacatcgtcttcacagcaggaatcggtgagaacgaccacgaggtgcgcgaagaggtttgcagttacctgcagttccttggcatagagctagacaaagaagccaatgccaagagaggcgaggaagtgatgatctccactcctggctcaaaagtaaaagtctatgtaataccgacaaacgaagagctggcaattgcaagagagacagttgcacttgtaaaataaggctgacggtaaagagaatgagcggatagatcccatgtctgtccgctcatctaatttgttagaatattctgaaaacggtgtgcaaaggggtcagacccctatgaagctccccgttattttacattttttagttgacaaacttattttacatgatataataatctaggtatgaataggagtaatgaagatgttaattagcctatcagacgttctgtcagaccagcataagacagttgaagaaacagtgcctgtggaattggaagaactgcagctgaaggccggtttgtttccggtagtcagcaaagaacctgtgcacgttgttgttacacacgtaaaggacaaggaattacagatcaaggcagagacgaaagtctcggtcatgattccatgtgaccgctgcctggagcatgtaaagcaggagtttgtactggattttattaagcgcgtggatttgagtgttgcggatgctgatttgccggaaggattagatgaatcaaatttcattgacggatatcatcttgacgtggacaaaatgctctttaatgagatattgataggatggccgacgaaagttctatgcagcgaagactgtaaaggcatttgtaacgtttgtggtcagaacctaaatatgggtacctgtgactgtgaagatacggggcttgacccaagaatgtcagttgtccgtgatttgtttaagaattttaaggaggtgtaacctatgtctatctgtccaaagaataaatcttcaaaagctagaagagataagagaagagctaattggaagatgagtgctccaaaccttgtgaagtgcagcaagtgcggagaacttatgatgcctcacagagtatgtaaggcttgcggctcttacaacaaaaaagaaatcatttctgttgactaagtacagagaagacaaggctttccgggattccggaaggccttttttcattttatttgactgatattcactattttttatctatattgtataaaaccgaaaggctatatttgtagcttttgtcgaaattataaaaagtgcttgcattctttattatgccatgctactatttaactacaaaatgaatcgattcaaattgaactaaatagtgtgaaataaggaaaaatcaatagtaatatgaattgatttcttattcttgtaaggaggaaaaggaatgaaaaaaattttagcattattactggcagtatgtatgatgtttgggatggcagcatgtggcggcacttctgaggacaaggcggcttctgacgataagacggagggcggtgcagataaaaagacaattgcattagtgcctccggcaatgatatccccttattacaagtcagtgatttcaggcgcagaggaagcatgtggcaagcttggaatagaattgaagacgctggcgccggaatctgaatcagactatgcttcacaggttcagattgtggaagatatgattacacagggtgtagacggcattatcctgtgtgctatcaacagcgatgcgattgtggcagctgttaagaaggctaatgaggcagagattccggtgattatgttcaatacccagaatgagctggcaggcggggaagtggcatgttatgtgagatatgatcagtatgaggctggcggcaaggtatgtgattttgtggcggaacagtttggcgaagatctgaaggtggcaattgtagaagggcttccctctgaccacacgacggaacgtatgggaggcttcgtcgataaagcagctgaaaagtacccgaacatcaaggtagttgcaagccaggccggagactgggaacgtgagaagggaatgaacgcggcggcgaatatgcttcaggcaaacaaggatatcgatgttatctttgctctgtgtgacgagatggggcttggtgctgtacaggctgtcaaggaagcgggctccgatgcgaaggtagttagttttgacggcaatcccaatgccgttgccagcattcaggcaggagaattggtatccacagtatctatcgggggaccgggaactggggtcgcttgtgtagaagcgctggatacgctttttaagggcgaaacagtggaaaagattgtgaacgtagaaacagagatcgtatggaaggacaatgcagaccaattcccatcagaggcggactaatggctgcgggcagatagccgtacaaacagatagaggactgcaataagagatagaaaagtacgcatgaaattgcgtacttttctaaaaaaggaggaagcagatgtcggcaaattttattttaaacatgtcggatataacaaaacgtttccctggtgttctggcacttgaccatgtcagcctccgagtaaaaaaaggggaagtacatgcactgctcggagagaacggcgcaggcaagtccaccttaatgaaaattctggccggtgcctatgtcaaggatgagggagagatcgaagtgttttccaaaaagacagagctggggaatcctaaggcggcggagaatcttgggatcagcataatttatcaggaactcaacctgattccgacactgaccgtggctgagaatatattccttggaaggtataaaatgaggggttccatccaggtgaactggaaagaggtatatgcagctgcggaagagctgcttcaggagctgggcgtggatgtaaaggcaacggactatatccgcgacttagggatagcgcagcagcagatggttgaagtcgcaaaggcgctttccatgaaggcaaaaatcattatcatggatgaaccttcggcaccgcttacggagagggagacgaagaacctcttccgaattgtgaagcagctcaaggaaagcggggtatccatcatatacatctcccaccggctggaggaggttctggagatttgtgaccgggccactgttatgcgcgatgggacaaccattaaggaaatcgagattgcaaacgtgacaatggatgaaataatccgtctgatggtcggaagggaattaaaggataaatatccgagaatagagaaagagattggtaaagaattattccgtgtcgagaacttatgcgcaggctccaaagtacagaacatcaatttttccgtcagggaaggagaagtactctgtgtgggaggtcttgtcggggccgggaggactgagacggtccgtgcagtattcgggctggatgccaagacaagcgggaagatatttatagatgggaaagaatgtgaaataaggaacccgaaggatgcaatccgtgccggaatcggttttgtaacggaggaccgcaaaggggaagggcttatcttaaaactaggcgtgggggaaaatgtgacgctggcggcgctggatagtttccgttcgggtatccatctgaaccttggcaaagaaaaaaatactgtaagtgaatatgttagcaggctgaatataaagacaccgtcaattttccaaaaagtagagaacctctcaggcgggaaccagcagaaagtggttctggcgaaatggctgttatcgaagtgcagggtgctgatactggatgagccgacccgtggaattgatgtaggggcgaaaattgaagtctataatctgataaatgaattggcaaaagagggaaaggccatactggtcatcacgtctgagataccagagttgcttgggatctgcgacagggttgttgtaatggcaagaggcagggtgagcggaacccttacaagagaagaggcgaaccaggaagcgattatgactttagcggtgggcgcagaggaaaggggaaatcagaaatgaaattaaaatcaaaagagagaaaaggaacaagctatgtggggattctgattgcattgatcgcgctttgcatcgtactgacttttaccagcaagagctttctgacggcagccaacctgctgaatgtttcccagcagatatcaacgaacttcctgattgcaatcggaatgacctttatcatcctgcttggcggcatagatctttccgttggatccgtcattgccgtgactgggctgatgatggggatcatgatgaagagctgggatcttccggttgcggcaagcctgttcttagggctcctgtttgcatccgttatcgggctggtgacggggctgttaattaccgggtttgatttgccgccatttattgccactctgggtatgatgtcgattgccagaggggcggcctatacaatcacagaggggcagccgatatacacctttccaaaagagttcctggcaattacaggaaggtacgggggaattccggtttttacgatactgattatgatagttatgtttgtgatagcagcgtatgtattgaagtatacaaaatatggaaggtacatatatgcgataggcggcaatgaaaactgcgcgaagctgtcaggaattaatgtgaaaaaaataaaatgcatcgcttatgtcatcagcggattttgctgcggcgttgcagctatcgtactgacctccaggctggattcagcagtgcctaccaatgcggacggcgcggagctggatgccatagcggcggttgtaattggcggaacatctatgaatggcggtgagggaactttagttgggacaatcattggtacgatgattatcgggatcgttgcgaatggcctgaatctgctaaatgtgcctcagggagcacagcggatggtaaagggcggcattatcgtattggcagttatcgtagacgtaatcaggcggaagagaagtcagaaggcgtagaaagaccctgaatgcagagaaagagcaagtattataagaaaattaggaggatatcacaaatggggcagcaaaacacaaggaatgggatgggccataagaagtggtgcatacctgatttatatatgaaggaaccgggcaatatgccgacgccttcccatgagagcattacgctcctgaatacaggggattcgacagcgaacgtgaagttggaactgatatttgacaacggggacgaaccagttctgctggacgggatccaggtgatgccaaagtcagcaaggcatatccgcatggaccaggtgcaggagtggaatattacgattcccacctctgtatgttattcggcaatcataagcagtgacaggaatatcgtcacagaatatgccaggctcaactggatagacggggctgcacagtcctttgcagtgatgccgtattttgaagactagttaaccgaaaagtcaaaaaaagaggagagacagtaatggagaagagaagagtagcgatcgtgaccggaggaacccgggggatggggcaggcaatcagcgtggagcttgcaagaaaagggaatatagtctgtgcaatataccgatcccatgaagagagcgcaaaggagaccttggcagtgatgcagaaatttgttcctgagtgctgtgtttacaaggcggatgtttcaaaagaggaagaggttcagcgtaccgtacgggagattggggataaattcggacggatagatattttggtaaataatgcgggaatctttgatttcaggttcatcgatgagatggattcggcttatctggaccgcgtaatagacactaattttaagagccaattttacatgctgcaaaatgcggcggagtatatgaagaagaacaattatggaaggattgccaatgcgtcttcaatttccgggcattttgctgactgcgggctggtggcatacgccgcgagcaaggcaggggtggatatgctgacgaaaatcagtgcggcggagctgggcccatataacatcagcgtaaatgcatatgcgccgggaatcatccatacggatatgacagatgccatgatacaggaacgtggggatgaacaggtaaaggatctgtgcctgaaccgatttggaacaggagaggacgtggctgccctggtgggatttttgacttcaccggaaggcggatatgtgacaggggaaattataggaattgacggcggaatgttcaaagtgcagaacacctatctggcttacgaacatgcaaaaaagcaaggaaactagagcttacataacagccgggaaccgaaaaaacggatctgagctataaaagcaggaggtttaaagatggaaggaaaaatgaaagcattattttcttatgcgccatatgataacaggctggaagagacggatatcccaaagattggggcagacgaactgttggtaaaagtgaaaggatgcggagtctgtgcgggggatgtaaaatcctatcatggaggcatccggatttggggaaccagcgaggaaaaccgctatattgaggcgcctgtaattggcggtcatgagttcttcggcgaagtggcagaagcagggtcagaaatgagcggatacaagccgggcgatttggttgtggcggagcagattgtcccctgcaatgaatgtgaattctgccggcagggaaaatattggatgtgcaccggttccgccgtatacgggttcaaacaacacataaacggagggttcgcagagtacatcaagctgcataaaaacagtattatccacaagattccggattcctttactacagagcaggcagtgctgacagaacctatagcatgtggaatgcatgcggtagagctggcggatatcggacacgatgacgtggttgtaattgccgggcttggagcaatcggaacttctatggttaatctggcaaggctctgtctgcctaagatgattgtcggaatagatgtaaaagaattccgcttggaaatgggaaaaaaatatggagctgattatgtgctcaatcctatggagtgcaatgtagaggaagaaattgcaaaattaaccggaggttatggctgcgatgtatatatagaggcatccggcagcggaatcagcgtgacccaaggtttaaactcactgaagaatcatgggagatatatccagatgggggtatttgccgatgaggttaaggcggattggaatgtgattggagatgggaaagaactgacaatcaaaggttcccatctctcagcgctcaccttccaggcagttatttcaggaattgaaagcgggctgatccgcacagacgggctgatatcacattcttttggactggataagtgggaagaagcctttgaggcagcggagaaagagccgacagccatgaaagtgatgctgatcccttaactttccgacatattcggaataggtggaaaaaatgttataagaaataggtatttgctgaaaatcctatcgatttctgctataatataacaagctatccaagcaaaatacataaaacggatatcagcggaaggatatgtctggatactcattgccgccggcatgtttcaggcatattcttgctgacaggaaggggattacttgtggcagtaataaaagatgttgcaaaattagccggagtttcggtagggaccgtttcaaaatatctgaatacgccggatttattaaaggaagataaaagggcggcagttgaggacgcgattcaaaaattgaactataaacccaatttgtttgccagaaacctgagagtgcaggattcgaagacaatcgcagtcattgcacaagaaatcaggaatccgtttcatgcggccctctttaatacaatcagaagagaagcattgaaatacaactattccgttgtcctatattcaatcaacgacgtaaatgggaatatagacacactgtttgaatcattgccaatccattatttcagcggtttaatcctctgctatttccatgatatggaacagtccatagattttgcgaagcgtcatgagaaagtaccgatggtcataatgagtaattccaacagatttttcagtgagtatgattcgaacaagatcgtacatgcagacttcacaagcggcattcagaaaatctgcgaatacctgatcgctgtcggcaaccacgacatagcatatattggctgcaagacaaaagacacgatccatgagccgaaactaaaaggtttcttaacgacgatggaaaagtatagtttaaagccccacagcatcatcaggcttgaaaaagaatacactatgcagacaggctacgagtcggcagaactgatccttaaaaaagacactctgccggatgccattctaagtgacaccgatatcatgtcaataggcgctttgaactgtctgcgcaaccacggtgtaaaagtccctgaagacatcatgcttgcctctttcgacaacatagagttttccaaatactgcaaccccaggcttacaacagtcaatgttcccatcgaacaaatgagcataagggcagtagaactcttagttgcccagttagaaggtaaagaagaggttcctcataacaacggctttgaattggaattaatgttaagagaaacaacaactgtaaaaaataagtaagaaagtataccgtttcaaattgctgaaaagggatcaatcattgataaaagaaggttaaaaagactaagaacagagaagacaaggctttccgggattccgggaggcctttttatgatatagaaaattactatggaattttctatatcataaaaccctccgggaggatgcacacgccgcaataaagtatatagccgcaaagcggcatcgcggcggcgccattgtgcaagcccctcatgagtgcgggggtggggatatgaggtgggcttgcctactttgttctgatataggaaattcctctggaaggatgcacacgccgcgataaggtatatagccgtaaagcggcatcgcggcggcgccaaagcgtgcaagcccctcatgagcaagggagcggggagctgaagtgggcttgcccacttttattctataataggattagggtgttaaaaggtcagtaatctttaaaatatatggaaatatataaggaaaaattcaatgcaataagcagatgataaaatattgaattttctgtatagttaccgcaggaaggagggattggcttgctaatcacagcagataaacgagaaggcctggcagagatatacaatcagctggttgaacttgtgggcatagaaaatacggaagagatctataaaaacatgaagggacagcaaataaccttccccatgcggctttacagaactgattatatatctaaaatagtaaatgaacggtataacggtaaaaatctgaaggctctggcgagagagtacggatataccgaaagacaccttagaaacctcttaaataagagacaaagttaaatatatcaatatggaatgcaggtcattgaaaaaataagtacataaaaaatggtaacaagcaggtcttaaacaaaagattaaggaggcaggaggtttcgatgggaatagttttctccattatactgatttatatgttcggcagagtagaaatctgttcgatgcgttttatagcaatactgacactcggtacgtttttatggccgccgggaacagggggaatcctgatatggatactactcaagtgttgtaagttcattcactagtataataattaactgcaataagagccaacctaagttgtcgatagcgctgctccacaaacctcagcgcagcccgctacgcctgcttatgtggagcggctctctcgaaacgttatcttctcttatgagtcagttacttattttacgatgtactagggggtgttaaaaagcgtgtgttttaggtataataaaatgaaataaaatcatagaaacgaaaccagtacatcgtaaaatcaagaaacatatggggcatgtcgttcgatttcccaaggggaagatggaacgatcgttttgacagcagccatatctttcacaggatgaattaaaacagggaggtcgtatgatggaacaccaaaagcatgttgtatgtgttggacaggcattagttgactgtatcaccagagggatggaagagaagccttataagaaaaatgtatatcgggcggactctatctcgttaaatacaggaggtgatgccttaaacgagtccatcgtcttatcccatctggggtaccaggtcagcctggtgtgcgcggtgggagatgacctggcaggccacatcgtactgcatacggccagaagcaatggagtagatgtttcccatgcggcggtatctgcaagtattactaccccggtggctaatctgatggtacaaaaaaacgggagccggcagtccgccaacagccctgctaccctgctggcgggatacgagccggacgaacgtgcctttcgcggggcaaaggccgtatcatttgccagtctgtttcgggcgccgctggacaaaaaagaaagtattcttcggttgatgaaggcggccaaagccgagggcgcgatcatctgtgcggataccaaaatgcccacatacagggagatttccagggaggacctcctggaaatcctgtcttacatagactatttcttcccgaatgaaaacgaagcgtcctattacagccggattctggcgggggcggagcaaagaacccttgccgggatgggcagtgtcttcctccaatatggggtgaaaaatgtggtcataaagaccggagaaaaaggctgcacggcagtcagcgggaacgggagttttcagtttcccgccagaaaggttaaggcagtggactccacgggggccggagataattttgtggccggatttattcacgggctgctgtgtgggtgggacttaagaacgtgctgcgattacggcacacactgcgcggctgtctctgttcagtatgtaggggcggtaaccgggatcaaacagcaaaaaatgaacggcagccggacagatataataaaatagatcaatgagtcagcggacatctggaaatcatgcaggtatttccaggtgttttctttttagtaaaaacagagaaattttcaagttataaatagcgaaaatatacaaaaataaagtgaagatcaaaaagcgattgacaattaaatatacaggtgatattctgagaaaaagaaagtccgtgcacgggcacaataacaaaataatcagaatattcacttgaaaggagaaagtattatgaaaaaaactctttgtatgctgttatgtattggtatggccgcggccatgtgtgcatgcagtccgggggaaaagaaggcgggggacgcgcccaagaagacggagggagagagtaaaggtttaattgggatcaccacatctatgtacaccaacgaaggtctcacgatcatgtgcgacacaattaaagagaaagtagaagaagagggctatcaggcagtcataaaggatgcaaacctggatcaggcccagcagacaaaggatgtagaggatttcatcagccagggggccaagctgattattgtagaggcatgtgattccgtaggcgtaaaatctgcatttgaattgtgcaacaaggcagatatccctgttctgagcgtgaaccaggtattaggagatgatttgctggaacttgtggtgggctccgttacaagtgacaattatacggcaggatatgaggtggggcaggaagtagccaaagaacttggcggaaaaggcaaggtatgtattctgacctacgatgtagcatttgtatgcagggagagaggcgacggcttcaaggctgccatggccgaaaatgaggggatcgaggtactggaagtctttgacggtgtatgtacggaagatgccgccatgaaaaagacggaagactggctgcagcagtacccggatgttaccgcaatctttggaaataattcgaactgcggagtcgggattgcggcggcagtcagatcggccggcaagacggatgatattctggttgcaaatgtagatggactttcaggggatatcagaaacatggaagacggggctctggatatcacagcggtatatccgatgaaggaactggcggcagaagcagcagataaggcagttgaggtgctgaaaaccggaaaatgcggcgaagatccacgcttaaaattcagcctttgtacaatagatgacctggatacttacaaagagtattggggaattgagtaaatacaggtgcgtaatatatacttgcggcagcgcacacgatgtactagtatcgtgtgccgccataaaggagacatagatgatgaatgaagaaaacattctgcagatgaaaggcatcaataagagcttcggcggcgtgcaggtattacatgatgtggatttttccatgcacgcaggggaagtgagggcgcttgcgggagaaaatggcgcgggaaagtctactttaatgaagatactgggagggatctatgactgtgatacaggtgaggtgatcatcgacggtgtgccaattggcctgggttctgtcgaagtggcgcaaaaacatggcatagcagtcattcatcaggaaatcgtgcttgtgcaggatatgacagtcggtgaaaatatctttctgggaagagagtttcagacaaaagcaggctttgtggattatcagaagatgtacaagaaagcggcggaaatattggaaaggatcggcctctcaaccctgaagccggatacaatagtcagagaactcagcatatcacagcagcagatggtggaaattgcgaaagcactttccactgatgccaggattatcgttatggacgagccaacttcatcgctgaccgacagagaagtggaatttttgtttggacagataaaatcactgagtgaaaaaggggtatcgattatctatatatcccacaaaatggacgaaatcaatgagattgcggacagtattacgatcatgcgggatgggcgccatattgtaacagcgcccatcagggagatcagctatgagcagattatccagaatatggtggggcataaaatagaagactattaccctgattatgaggtgaaactgggaaaagaagtgctcagggttgaaaatttgacaacagaaaaggtagaaaatattaatttttcactttttgaaggggaaattcttgggataacaggtcttatgggggcaggaaggacagagcttgcaaaagctttgtttggcttggacgaggttcaggccggcagtatttatctggagggtgaaaaatgtatcgtaaaatcaccgcgggatgcaatccagaagaagatagcgcttgtccctgaagacagaaaagaaaacggcctgtttttggaaaattcaatttcctttaatatgacagtcacagtaatggatgaatttataaagggaatctccgtagacgccaaaaaggagcagcagatcctagatgaatatgtaaaccagcttgaaattaaaatggcggatacccagcagcttgcggttgaactcagcggaggaaaccagcaaaaggtagtgatatcgaaatggctggcgtcgaacccaaagatcttaatcctggacgaaccgaccagaggggtggatgtaggcgcaaagtcagatatataccatttaatctgtcagattgcagagcggggcgtggcaatcatcttaatctcttcggagctgcccgaggttatgaatatgagctccagaatcggtgtcatgtgtgaaggaaaactggtcaggttttttcatccgaagaaggaagaagtcacccaggaacagatcatgcattatgcaacaggaggatatgaacatgaaatttatcaccaataaaagccatgtcagccaaagcctgaaaaaatttttgaagcgcaactttatgatattgatcgcgctgctgctgattgtactggctctgtcggttttcacagatacatttttaacagccgataatattctgtccgttacgaggcagatcagcgtggattccgtgctggcgtttggaatggcaatggtattgattatcggatgcattgacctgtccgtaggcagcgttcttgccctgagcggctgtgtctgtgtttctatgattgaaagcggcatccctacggcagcggcagttatcattacgctggtattcggagccctctgcgggatcatcaatggcctgcttgcaacatttacaaccatcccgagttttattataacccttgccacgcagcagtgcttcagaggcgcggcatatcttatgacaaacggaaaatcaatcatgtgctatgatgagacgttcagtgcgatcggaaccggatatatagggcctgtcccgattttggggatcgtcattattgtatgccttgtatttaccagcatcctgcttaataaaacaaaattcggaagaggcatgtatgcaataggagggaacagaagcgcggctgtatatgcgggaatcaaggtgaaaaaaataaccgccagcgtctttatatttaccggcatcatgagcgcaatggccggtattatgctggcatcgagagtgtattcagcccagcctgcatccggtgcgggatatgaatgtaatgcgattgcggcagcggtcttaggcggcgtcagctttaacggtggaattggaactgcaggaggcgtgatgatcggcgtgctgattatcgggtttatgaataatgggctgaatatgctgcatgtcacctcctactggcagattattgtaaaaggacttcttatattattggcagtgtacctggatactttgaggaataacaagcgattacatattaagaagaggggataggcatgtatacagaaatagaatttataagacagtatgaaaaatattccgtactgatgaaaggaatttgcgggaagggggaaccgggactggaaatatttctcgatttccctgtagttatgcaggacatttccggcgcgaaaacaaagcttaggtacgatagttatgaaagtacggaacatggatatcaggctggaatagaggccagggatttatatggcaactgctataccatcacggacgtatggacagcagagaaggacagctataaactggaacgaaaagtgtcctgcaaagaggtaaaagagcagacggggatccgcctgacttctgaattccggtgcagggatttgaaggcagcatcttttgacgactatgaatttataatacccggggccctgtataaccataatgatacggacggggacggggtagatgattatctgggaacattcagccaggattataaggacgacagaaatccggctctttcggtcacagcttatggaaaaaaaggaaattggtcggtatctctgatcagaggggatttaccgcaggaggataagacaatcacccgggagcagatcaaagcccgccattttattcatcatacagatataggttccctgggaatcgcaccatcccagtatcggacgcaggaatttatcctgcgatgcgattaccccttctatgaaagaaattcattctgtctcaatgtagatggttcagagtggtcagcctacaaagagattggagaaaacaaggacttttccatgacatatctgctctgcataggggaggcagaaagcctgacagaggcatcctggaatacgacacttcttcagctggacagaattctggatcaggagacagcactgccctttactttagaggaggcgcagcattacaggcgtgaaatgatccacaacagcttccgggagttcccggaaaagaagggagcgccggcggggtatttcgtacatttttctccacgcagcaattatggggaacagaaccttctggaatatggtttctgcggggcacagacacttctgagcctggacatgctggcggcggcaaaggacaatggatccggggaatacagggaaagggcgcttaaaacggtcgattactttgtggatcactgtattgaggagtcgggactgccgaacggaatttacaatgtggataaggaggagtatgtatactggtggacgggaatcctgtttccgttccagtactcggatgacagggaggaactggaggggtatcttggcagccaggtggtgagctctttgatggaaatcgcaaaggagctgaaaaaggtaaagggtaactactgcaggtctatggtcgattctatgtactatttgctgcggtgctatctgttcgaaaaggaacaaggaaaggaacatccgaaatggctggaagccgtaatcaaattctgcgataagctggttgagatacaaaatgaagacggttcctggaaccgcggatattcgatggagggagtaccgcttacaaatccgccgcagtggttcggggcgtccaaaaaggagcagggttccggggcaatcttcccggcccagattctgacagcactgtattcgcttacaaagttggaaaagtacttgaagtctgccgaaagagcagcatattttgtgtacggcaattatgcttcccaggtggaatatatcggcggactcaacgatacgacacacaaaaagtcggttaaaatagacgcagtcggcgtgatgtttgccatgcgtaccatgttggtggtgtacgagcagacaaaggatgtgaagcttcttacaggagcaagggatgcagcccgcatactggcaagctggacttacctttgggacatcccgtttgataaaaatacactcctcggaaagcacggttttaaaacgacggggtgggcagtatgcgatgtgatacctgcgggcagttatgtagactgtgaatttgtagaatttattcccgaactgctgcgcatcgccggatacctgaaggacagggagctggcagtattggcgaaaatagtgacacgggggatgcagcacggcttgtccatgcctcagaatatgtacggatatgcaatgccgggggtacagtgtgaggggtatatgacctccctctggctggcggatacggagtataagggcttttccggtgctgcagccaagaacaagggggatgataacgatacatgtaatggactggtgaacgggcaggcgctattgaacttagactatttatcacagaagtaccatacgatggattttgacacaatcatagaacaaaccgtgaaagaaggataaagagtgttcagaactatgagcggtttcgacggaggtatatatggcagaaataattaataatccggtactgaaaggcttccatccggatccctgtatctgcagggcaggagatgactattatattgcagtttcgacgtttcagtggtttccgggggtagaaatctatcacagtagagatttagtacattgggaatttataagcaggcctttaaatgaaaagaggcttgtggatatgacgggagtgcctgactcaggcggtgtatgggcgccgtgcctgacatacggcgatggtattttctatctgatctattccaatgtaaagacctaccggaattactataaggatgtggacaattttttgacatgcagcaggagcatctgcggcccatggtctgatcctgtttatctgaacagcagtggttttgatccgtccttctttcatgatgacgacgggaaaaagtatttgctgaaccaacggtgggaccatcgggataaatcagcttcgtttgatggaattgtactgcaggaatacgatgaagagaaacaatgtctgacaggaaatccgcagaagatattccagggaagcagtattgggatgacggaagggccgcatctgtataagatcaatgggatgtactatcttttctgcgctgagggcgggacattctatgagcacgcagtgacagttgcacgtgcagggaatatcgaaggcccttacgagctctccccctatcatcccttgctgacatcgtatggacatccggagctggcactgcagaaatgcgggcatggcagcctgatcagcacgcaggatggggaatggtatatggcgcatctgtgcggacggcccaacgggaaccagaaccgctgtatgttaggcagagagacggcaattcagaagctgaagatgacggaggacggctggttcgtactggatcagccatcagggctgccgaaggaggcggtaacggctccggaactgccccattttccagtacagaaaaagagtgcaaagatggtctttccgggcaggctcccggacgaattccagacattgcgcatccctttagacagcaggtggatggattttaacagagaaaggcagtctctgatcctgtatgggaaagagtccatggaatcactgcatacacagagcctggttggtataaggcgggaacactttcactttactgctgagacgaagcttaggtttgatccggttcactatcagcaggcagcaggcatggcgctgtattatgatacgacaaattatttttatctgaatctgagctgggacgaggaaaaagggagagtattatcggtgcttgtctgcgatcatggaaaaatcagggtcagtaaaggcgaacgccagccagccggcagtgcacaggaactatatctgagaatggaagtgagaaacagggaggcgcagttttgctggtcgcccgacggggaaaggtatcagaatataggggaaatactggacgcttcgcagctgtcggatgattattatgatgaggccgtacatggactcaggttcacgggaacctttcttgttctgtgttgccaggacacttcagggcggcgctgcagggcggaatttgaatatatgatttatcagccgctcgatgaagaagagtgacgaagaaagagggagtattgtgtttgcaggcaatattccctttcataataaaaaggagggagtaccatgtttatagagttggaatttatacgccaatttgaggcctattctcccatgatatccatatggaagaacagagaagagtccaggccggatatgagcgtatttgtggactttcctgttgtgctgaaggatatcaaaggggcaaagagaaaaatccgctatgatgcctgcggtgtatatgaggatggtttttatggagaggcacaggtggaagatcggtatggtaatcagtataagatcagagatatctggaaaatagaaaaccagctgatcagattggacagaacggcggtatgcacccgctttaccgaagaaacagggatccatctgaccacagagtttcgggtcaggggcagcagggaagcgtcttttgacgattatcaattcgtgattccgggggccttttataacaaaaatgatacagacggagacggggaggaagattaccttgggacttacagccaggattacaaggatgacagaaatccgtctatgtccgtgaccgcatatgcacaaaaaagccaatgttttctatcactgctcagggcagataccccatgcaaagacacgacaattacccgccggcagatccagaagcggcattttatccatgatacagacattggatccttgggcattgccccctcggaataccatgtgggagaatgcattctgcgctgtgattaccccttttatgaaagaaatacattctgcctgaacgtggacggctccgaatgggcggcttatcagggtgtggaagaggaaacaaaattacagatgtcctatctactgcaggcgggggaggcagaaaggcttacggatgcttcctggcagaccacggccctccagatcgaccggctactgcgagaagaggtgcctcttccatttactttagaggaatcggtacagtataggagggatatggtcctcgacagttttcgggaattcccggataaaaagggaagaccagcgggctactttatccatttttcgccccgtcagagttatggcgaacagaacctgctcgaatatggattctgtggtgcgcagacactccttgcatatgatatgctgtcggctgcatgggaaaaaggacagcgcggtgcagaatgtcttttgcaatacagagagagtgcacgaaagacattggattatttcgtggaaaactgcatagagaaatcggggcttccgatcggcctctatcatgtagataaagaagaaattgtatactggtggacggggattctccttcctttccaatattcccatgacagaaaagagctggaggattatctcgggaaccagattgtgggggctttaatagatatcgccggtgagctagcaaaagtagagggaaattacttcagatccatgaccgatacgatgttctatttgatgaaatcatatctgatcgagaaagaaaatggacaggagcatccggagtggctgcaggcggttttaaatttctgtgaaaggctcctgcggatacagaatgcgaatggttcctggaatcgtggatatacgatggaaggagagcctttggcgcatccgcaggagtggtttgggcggtcagaaaaggaacaggggtccggggcgatattcccgataccgcttctggtagaagtgtaccgctatacgaaggaagaaaagtatctggaatcagccagaaaggcggctgagtttatcctttgccaatatattggggacaccacatatataggaggcattaacgatacttcccacaaaaaatccgtaaagatggatgccgcgagtgtgatgtttgttatgagaagtatgcttgcattatatgagcagtgcggcgatacacaatatctttcgggtgcggcagatgcggccagaatccttgcgggctggacgtacttgtgggacataccctttgatgcggacacgctgctcggaagtcatggcttccggacaacaggatgggcgggctgtgacgtgattccggccggcagttacgtagactgctcatttgaagaggttgtcccggaatttttaagaactgcagagtattgccatgacggcagactggcaagggtggcaaaggccgtgacgagagggatgcagcagggactgtcaacgccctcagacatgtatggatatgccatgccgggagtccagtgcgagggatatatgacgtccctttggctggcggacacggagtataaagaattctccggagccgcggcaaagaataaaggggatgataacgatacatgcaatggttttgtaaacggcatgacacttctgaacctggattctctgaaaagaaaatatggaaccctggattttggagatatttgtaaaaatctgcacaattaataaccaagaatggcagaaggcgtggtataattcatcttgaagtacactagtcggaagaggaataaagtatggtaactattaaaaagattgcggagatagctggtgtgtccaggggaacggtagaccgggtattgaataaccggccgggagtaaatgcagaaacctatcacaaggtaaaggaaatagcagacaagttaggatatgagcccaatatggccgggcagatgctggcggccagaaagaaaaaaatcagacttggattcgttgtatgcgatactccggtggatttgttttttgcggatgtttaccgggcggcaaggagaaaggcagaagaactgaagacctttggtgtcactgtccatttttatctgatcaaagaattgtcagatcagtttattgcgccccttcttcaggaagcagaggacgatgaactggatggaattgcattagtgcctctcaatatggactccatcaggcaattcgttcaaaagatgaataagagaaatatcccaatggttttttttaatctggatatggaagatgccaggaggctctcttacgttggatgcgattaccatgattccggaaaagttgcggccggcctggtcgcgcttgtgacccgagaaaaggggaagatcgctctggcaaccagttttgacgagcagtcgccttcctttctgcagaggctggatgggtttatagaggaactggatgaaggatatccgcagatcgagatcgtaaacagggattctaatattgtctttcaaaagggagaatattcaaatgttcttgaggttgtgaaaaaaaatgtggatttagacgcgctgtatatcatcaacccgggtgactacagcatatgtgaagaagtcgaaaagctggataaagaaagaagaatcaagatgatcaccaacgacgtgatcaataagcagaagccctttatggacagaggggtcattgccgcaaccattgggcagcagccggaaaagcagggtgcactgccgctgcagattttatatgattatatcgggctggggatagaaccggcaggacaatatttgacggaactctccatccatatcagacaaaatatatcctggaagcgggagtgataggcaggagggacgcttaccgacagccgtgacgtgctgagaaaagcccctgtcctgttggaaatacgggccgctgcgccaagcagcagtaagtggaaatccgcagaatcagccggaaccgaacacattcaccgcttaatctgatgattaagcggctcaggtgttctgaaaagctgctttggtgagcagcttttctccggctgattctgcggatttccgctaactgctgctaggctcgctggaagcatttccaacagggcaggggcttttctcagcacgtcacggctgccggtaagctggtgcttccaagcggcaggtaaaggctcgctccccgaggggagtttagaccgtggcggcgtatggggatgactttacgggcatattagcagtagtttggctgtgaatgaagttggaagggagattgagtatgcagacgacacgagttattgttttgccttatgattctaagtggaaaacagattttgaaaatatcaggaaggaaattgaagatgctgctggcgatttgattattggcattgaacatgttggcagtacttcagtggcagggctttctgctaaaccttgtattgacattgatgtggtgatcaaagattattcggtttttcatgttattgtcagcagattagaaacaatcggctatatccatgaaggcggcttgtgccggtcccttcatggagcgtccccctccgcccgttaaagcaaagtgaactcccacaactatttccatttttttgttgatttttagattgatgtctagtagaattaatgcagtagcgttaggaggaaagaaaatgtctgatattacaagaatcgcgttagatgccatgggcggggacaatgccccaggcgagatgattaagggcgcggtagaggctgtccggcagaggaaagatattaaggttctgcttacgggacaggaggaactgcttaggaagacgttatcagaatatacttacccgacagaccagattgagattgtgaatgcaacagaggttattgagactgcagaaccaccggttatggcgattcgcaggaagaaagactcttccattgtagtggccatgaatctggtgaaaaggggcgaggcagatgcatttgtatctgcgggaagttctggtgcggtactggtcggaggccaggtgattgtagggcgcattaaaggcgtggagagacctccgctggctccgctgatcccgactgcaaagggcgtatcactgctgatagactgcggtgccaatgtggatgccaggccgtcgcatcttgtccagtttgctaagatgggatccatctatatggagaatattataggaaagaagaaccccaccgtcggcattgtgaatatcggggcagaggaagaaaagggaaatgcccttgtgaaagagacctttccgctgctcaaggaatgcagggatattaattttgtggggagcgtggaagcaagggatatcccggcgggagctgtggatgtagtcgtctgcgaggcatttgtgggcaacgtgatcctgaagctctttgaaggcgtaggcggaactctgatcagtaagattaagggaagcatgatgacctctttgaggacaaagataggcgcgcttctggtcaaaccggcgctcaaatccacactgaaagactttgatgccagcgaatacggcggagcgccgctactgggattaaatggactagttgtcaagacacatggaagctctacttcaaaagaagtatgtaattcaattatccaatgcgtaacatttaaggagcagcagatcaatgagaagataaaggctgccatccaggcgcaggaagaaaaaacgacaaattaatgtagcgaagaaagggaagaggactatggaatttgaaaaattacaggaaattattgcagacgtattaaatgtttctacagaggatattacgatggaaacaacatttgtagatgatttaggggcagattcattggacattttccagataatcatgggtattgaggaagaattcgacattgagattgacaacgatgaggcagagaagattacaacagttggagatgccgttgagcagataagaaaggctgtagaataagtggaacagatgaaaaagcccctatgggctttttcattttaagtgaaaggtgaacaatatgaaagatagtttaaaagaactggagagtaagatcggttataagttccgggatttttctctgttgcgccgggccatgatgcacagttcctatacgaacgagaagcatcttgagaagtaccactgcaatgaacgccttgagtttcttggagatgcagtgcttgaactggtttccagtgaatatctgttcctggaatttccgaaggtgtcggagggggaactgacaaagacaagggccagcatggtatgtgagccgtccctggctttctgcgcgagggatatagacctgggttcctatctgctgcttggcaagggggaagaggcaaccggcggaaggcaccgggattccatcacatcggatgcactggaagccctgatcggggcgatttacctggacggtggttttactaatgcaaaagagtttatccatcggtttatactgacggatttagaagataaaaagctctttttcgatagcaagactattttgcaggagattgtgcaggcaagaatggcagggagtatttcataccggctgatcaaagaagaagggcctgaccataataaggctttcttcgtggaggtcatgattgaggaaaatggctacggcataggaaaaggaagaaccaaaaaggccgcggaacaggaagccgcatataaagcaatactagcattgagaaaagaaaaatagagcaggtgttatatgtatttaaaaagcattgaggtacagggctttaagtcttttgccaacaaaataaaattcgacttccacaacggaataaccggtatcgtcggtccgaacggcagcggcaagagcaacgttgccgatgcggtacgctgggttctcggagaacagcgggtaaagcagctccgtggcgggagtatgcaggatgtcatcttttccggcacagagaaccgaaagcctctgagctatgcatcggtggccattacgctggacaattccgaccatcagcttccggtagattacgaggaggttacggttacgagaaagctgtaccggtccggtgagagcgaatatctgataaatggcgcgggatgccgtctgaaggacatcaatgagatgttttatgacaccggcatcgggaaagagggatattcgattatcggacaggggcagatcgataagatcctgagcggaaagcccgaggagaggagagagctgttcgacgaggctgcggggattgttaagtttaagaggcgtaagaacctgtcagtcagaaaactggatgaggaaagacagaacctgacccgtgtcaatgatattctctcagagcttgaaaagcagatcgggcctttaaaacgccagtccgaggtggcgagggagtatctcaagaagaaggaagaactcaagacttacgatattaatatgttcctgttggagacggagcggatcaaagatcagattcgtgatctgaacagtaagtatcaaatcgcttcggacgagcttgaagaagcaaacgtccggtacgaagagatgaagacggagtacgaggccattgaggaggaagtggacagcatcgacttttccattgaaaaggcaaagagccagctcaatgagacgacccttctcaagcagcagctggagggacagatcaatgttctgaaagaacagatcaatacggttcggatgaatgacgagcactatgataaccgtctcagtacgatccgtgtggagatagagaccagacaggcccagcgggcggaacttgcaagggaacagacttctgtaagggccaggctcgcggaagttgcaaagagcgatgcacaggcaaaggaagcgctggtggatgtgcagagccggattgcctcggatacggcgcagattgaacagagtaaggccgagatcatagagcttctgaataacagggcgtccactaaggctaagatccagcattatgcaacgacacaggagcagattacaacgagaaaatccgaactgggcaggctgatcctggaggtgtcgtcagacgcggagaaacagaatgaagtactcgccgcatacgaggaagagctgcagcagatttccgggagaatccatgcttatacggaacagatcggcacgaatgagcaggagatcgataagctccagcaggaactgtccgggaagcaggagcagctgcgtattggacagaccgcctaccacagagagtcttcccgtctggaatccttaaagaacataaccgagcgatacgacggatacggcaacagcatccgcaggattatgagcaataaggacagggaaaagggactgatcggtgttgttgcggatatcattaaagtagaaaaagaatatgagatcgccgtggagacggctttgggaggcaatatccagaacattgtcaccgacaatgaggaaaccgccaagcggatgatcgcctatctcaagcagaataagtttgggcgtgccacgttcctgcctctgacaagcatgcatggaggcggcgggatccgccagcaggaagcactgaaggagcccggtgtgatcggccttgccagcacgctggtgcaggtggaggaccgatttatggggctggctgaacagttgcttggcagaaccattgtagtggataacattgataacggaatccgactggccagaaaatacaaacaatcgctccggcttgtcactctggaaggagaactcatgaatcccggaggctccatgaccggaggcgctttcaagaattccagcaacctgctgagcagaaggcgggagatagaagaatttgaaaaaacggtcaggatgctgaaaaaagagatggatgactgtgagcagtcggtgaacgagatcaaagcaaaacgtacttcatgctacagtgctattgatgagatccagcagaaactcagaagagcgtccgttaaagagaacactgcgaaaatgaatgtggagcaggttcagaaccggcagcgcgaagctaaattacgctgtgaagggtatctcaaggagcaggagggcttagaactgaggctgcgggagatcctggataatgaggactccatccagatggaactggagacatcagaagccctggagaaggagctgaacaaccggatcggggagctgcaggaaagcctggaatccgacaaggaaaaggagaccgtccagctgagacattcggaagaagtgcatctggcatatgcgagcctggaacagcagaatgcgtttattctggaaaacataacgcgaattcaggaagaaacggaaaagttcgagatagaattaaaggaactggacatcaataaaggtaatgcttccgaagaaattcaggaaaaagaggacaagatccaggatcttagagagaccattgaaaattcaaaagagctttttgaggagataaatacagagatcaagagccaggtcgccaagcgggaggagctgaaccagaagcataaggcatttctcggaaagagggaggaactctccagacacatgtccgaactggataaggagtgcttccggctgagcagccgcagggaatcctatgaggaggcctctgagaagcagatcaactatatgtgggatgagtatgaactgacctacaaccatgcgatggagctgcgtaatgaaaatctgacggatctctcgtatatgaagcgacagatccaggcgctgaaaggcgagattaagaaactgggttctgtcaatgtcaatgcaatcgacgactataaaagtgtatcggagcgctacgagttcctcaagggccagcacgatgatctggtagaggcggaagcgacgctgatgaagatcatagatgagctggatgcggccatgagaaagcagtttgaagaacagttcgcgctgatttcaaaggagtttgacattgtattcaaacagcttttcggaggcggaaaaggaactctggaactgatggaggacgaggatatcctggaagcagggatccggatcattgcacagccgccgggcaaaaagctccagaatatgatgcagctctccggtggggagaaggcgctcacagcgatttctctgctgtttgcgatacaaaacctgaagccatcaccgttctgccttctggatgagattgaggcggccctggatgacaacaacgtagtgcgctttgcacagtatctgcacaagctgaccaggaacacgcagttcattgttattacccacagaagaggaaccatgacttctgcggacaggctgtacgggatcaccatgcaggagaagggggtgtccacactggtatccgtggatcttctggaggatgaactggaaaaatagacagcagttccggcttatctgaactgttaaaaaaagatagcgagggagaagaaaatggaggaaaagcagggcttttttaaacggctggtatccggcctgaccaaaacaagagataatatcgtctccggtatggacagcattttccatggcttttcaaaaatagacgatgatttttacgaagagctggaagagacactgatcatgggagatctgggtgtccacacgaccatggagatcatggaagacttgaaagcaaaagtgaaggaaaagcatatcaaagaaccaatcgagtgcagggagctgctcattgagagcatcaaggagcagatgaatgtgggggagactgcctacgaattcgagaaccgcatctcggtcgtattcgtgattggagtgaatggggtcggcaagacaaccacaattggaaagctggctggcaagttccgtgagcagcacaagaaagtaatactggcggctgcggatacatttcgggcggcagcgggagagcagctgaaggagtgggcgaacagggcacaggtagagatgataggcggccaggagggcgcagatcccgcatccatagtctttgacgcagtggcggcagcaagggcaaggaaggccgatatcctgctgtgtgatacggcgggacgcctccacaacaagaaaaacctgatggaggagctgaaaaagatcaaccgggtgatcgacagagagtatccggaggcacataaagaaacgctggttgttctggatgccaccacagggcagaatgcactgtcacaggcaaaagaattcaacgaagtatccgatattacaggagtcatactaactaagatggacggaactgcaaaaggcggaattgcagtggcgatccaggcggagctgggaatccccgttaaatatatcggtgtgggcgagaccatagatgatttacagaaatttgatgcggatgaatttgtaaacgcgctattctacagtgactcaaaagaagagaacagcggggaatagcctaagaaagaaggggtaaaatgttaacattagagaagtttgaagaagcaagcgaaatcgtaaaacaggtaacaaaccagaccaagctgatatacagcgattatctgagcgaggcgagcggtggcaaggtatatctgaagcccgaaaatatgcagcacaccggtgcatataagctccggggcgcctactacaagatcagcactctgtctgaggaagccaggcagaaaggtctgattaccgcatccgccggcaaccatgcccagggagttgcctacgccgcaaaaaaatatggatgcaaggcaacaattgtcatgccgacagttacacctctgatcaaagttaaccgtacaaagagttacggggccgaggtcattctttacggggatgtatatgacgatgcctgcgcctatgccttagagctcgccgaaaagcacggctataccttcgtccatccctttgacgacctggacgttgcaaccggccagggaaccattgccatggagatcgtccaggaactgccgacggtagactatatcctcgtccccatagggggaggcggtctcatatccggagtggctacgctggcaaaaatgctgaatccgaagatcaaagtgatcggtgtggaacctgcggaggcagccagcatgacggcggctctccaggccggggaagtggtggaactggagagcgccaacacaatagctgacggcactgcggtgaaagccgtcggagttcagaatctgccatatgtacaggaaaatgtagacgacatccttttggttgaggacgacgagctgatcggcgcctttctggatatggtagagaaccataaaatgattgtggagaattccgggcttctctctgttgcggcattaaaacagctcgagtgcaagggcaaaaaggttgtctgcatcctgagcggcggcaacatggatgtcataaccatgtcttccatcgtacagcacggcctgatccagagagaccgtatcttctccgtatccgtactgcttccggacaagccgggtgagctggtgagtgtggccgctacaattgcggacgagcagggcaatgtgatcaagctggagcacaaccagtttgtaagcacaaacagaaacgcagcggtagaacttcgtataacaatggaggctttcggcacagaacacaaacataagatactgaatgcccttgagaaaaaaggctttcgcccgaaactgatcagcgcaaaattatactaaagaaaaagtgatattgaaatagcagcggccggcagatgaatgtaaattgatttgccggcagttttgttaaacagcaggcccgattttcgtacgcacagcttttgtcccgcggaatgtaaggcccaagaaccagtagtccttactactggaaataaagagtagaaaaggagtgtttcatatgagccgcaaaagaccaagagagggagaaatatacacacattttaaaggaaaacgctacaaagtactgcacatggcagtgcacacggaaacagccgaagagctggtggtatatgaagccctctacggcggactcggcatctatgcacgccctctggatatgttcctaagtccggtggaccatgaaaaatatccggatgccccccaggaataccgcttcgaactgactggttttgtaaagcctggggagacgttatctgaagaggagccggtacaagaagaagttcccctgatcatccgcttcctggatctggagtccaatgaagaaaaactcaagttcctccagcgccacaggacagagctgaaccagcacttcctcagtacagcggcagaaagcctgggatatacagaatcaggaaaaacacccgaacagcagtatgagggagtcatcaactgcctgagaatgaaaatcaagtacgagacggggaggcttagataaggcgagaatgtggctggtatggggacgcgtcagtcctgctgtgccggccagcccccgcaccggcacagcaggactgacgctggacattcccgccggaatgccttatcctgaagccgacgcaccctttttcgggggcggtggatcttggctgactggtttggagacattatttacactgtcattaggtatatagatatgcatccgccggtacacatccgctgcattccgtcgcgggcacctccggagggggatgttccggttggatgtgagtagtctcagagaaggggaaggtgttttcgggggcgtgaatgtgggggttagcatttctttacagaaaaagaaggatgaatcaggctgaaatcatagctacaggctatgatttcaaggggacctgcaggggaaaattatcgaattttccccgaatgtccccggtgccttgattcatccttctttttctgtatagaaatgcttcccccacattcccgtccccgaaaacaccttccccttctctgagacggcctcgtgagtcgacaccacttcccccttctaccccctgcgctttttttcgaggagtgcgtggattttgtcggttggattcagtacggatccgatggaggtgtcgtgattcaatgaatctatgatgagtgccaggaatttgctcatatctgcttttacgaagtagggtttttcttttacaatcggcggcagataggtgaggtttgttgtgattacccggtcaatgtatcctttttcgtagtattcgtcgaatttttcgaagccgtccgtgaagaggccgaatgtggtgcagacgaagactctggctgcgtggcggtcttttagctgtttggctacatccagcatgctttcaccggaggaaatcatgtcgtctacgacgatgacgtcttttcctgttacatcgtcgccgaggaattcgtgggccacgatggggttcttgccgttgattacagtggaatagtcgcggcgcttgtagaacatacccatctctacgcctagtatgttggagaagtagactgcgcggtgcatggctccctcgtcagggctgatgatcattagatgctccttatctacccgtaagtctggcactgaacggaataatgccttcataaactgatagggcggattgaagctgtcgaaccctttcagtgggattgcattctgaaccctgggatcatgcgcgtcaaaggtcacgatattggtgacgcccatggcggtcagttcttccagggcaatagcacagtccagggactctcttttcgtcctcttatgctggcggctctcatacataaaaggcatgatgacattgatccgctttgccttgcctgtagcggcggaaatgatccttttgagatcctggaaatgatcgtccggagacatgtgattgatatgtccgttgaccgtgtacgtaaggctgtagttgcatacatcggtcatgataaacagatccgtgccgcggattgtctccttcaagacccccttcgcctcaccggagccaaaacggggacaacagcagtccacgagatagttgcgggattcatagttcacatagaggggggaggaggattttacttcgcagatcgtattttctcggaaggatacgatgtagtcattgacctttttccccagcttttcacagctttccatggccgctagcttgaggggggcgacgggaagcgttttttctaataattcaatatttgacatgattttctcctatgtttgacgaatttgacgggctggaatccagccggttatctatatatggttatatcattttttatgctgaaattcaagcacagcttgcgcaaaccgcgaattatgatataatgaggttactgttcaaaccgtgccgtgcacctcgctgcacggcatcggagacgaagtagtgatggtctctgggcatctgcccctcgctgtaggcgactttaaatgagccagatgccgttactatgcgcggcctgcggctgtgaacagtaacattatgaaaagcggactgggcaagtctattcaggactttgaggagatagaagatgaaacatgagcatatagtgagtaccgtacatcctggaagcattggggaagagatggggatcgagcccggggacaggctcctggccattaacggcaatacgatagaggatgtatttgattatcactactacgttgacgatgaaaatatagtattattgatagagaaatccaacggagaacagtgggagctggagatagaaaaggacgaggacgaaggactgggactggagttcgggcagagcctgatggacgagtaccgttcctgcagaaataaatgcatgttctgctttatagaccagatgcccgcaggaatgagagaaacgctgtattttaaggacgatgattcgaggctttcctttctgcaggggaattatattaccctgacaaatatgagtgatcatgacgtggagcggattgtgaagtaccatttggaaccgatcaacatctcattccatacaaccaatcccgaactgcgctgtaagatgctgcataaccgttttgcaggcgatgccctgaagaaagtggatatcctgtatcagggaggaattgagatgaacgggcagattgtactctgcaagggcgtgaatgacggggaagagctggaaagaagcatccgtgatctgaccggatatctgccatatctcagaagtgtatccgtggtgcccgtgggcctgacgaagtttcgggacggtctgtatcctctggagccatttacgaaggaggatgcaaaggaagtcctcagggttatccataagtggcaggatcagatatatgaggttcatgggattcatttcatccatgcaggggatgagtggtatatcctggccggggaggaactgccccgggaggaaagatacgacggttatctacagctggagaacggcgtgggtatgctgcgcctgctgatggatgaattcggggcagggctggagcacatcaaaggggacgtcaggaagagagagctgtcatttgcaaccgggcggcttgcttacccctatttggagcgtatgctgggcagactaaaagagaagtttcctaatataaccctgcacctctatgaggtgaggaatgactttttcggcgaactgattacggtatccgggctaatcaccgggcaggatctggccgctcagcttaaaggcagagagcttggcgatgctctgctgatcccctgcaatatgttaaggaccggcgaggacatatttctggatgattttactgtggaggatgtggagaaggctttacaagtgccggtagatattgtaaaatcaagcgggcaggatttgattgacgcagttctgggccgaaactgataatttgaagacgagaaaggtagcagataaatatgagtaaaccagtagtagcgattgtaggaaggccgaatgttggaaaatctacattgtttaatgctctggcaggcgagatgatttcaattgtaaaggatacgcctggtgtcaccagggaccgtatctatgcggatgtgagctggctggaccgggagttcactttaattgacaccggaggaattgaaccggacagtaaggatgtgattctgtcacagatgcgggagcaggcacagatcgccattgacacggcggatgtcattatctttataacagatgtgaaacagggtttggtagactccgattctaaagtggcggacatgctgcgcaggtcggcaaaaccagtgatccttgttgtaaataaagtcgataattttgataaatttatgccggatgtatacgaattctataatctgggaatcggtgatccggttccgatttcagccgcttccaggctggggctgggagatatgctggatgaagttgcggcacatttcccggaaggctcgggggaagaggaagaggatgacaggcccaggattgccattgtgggcaagccgaatgtcgggaaatcttctattattaataaacttttgggcgagaaccgggtgatcgtttctgacgtggcgggcaccacaagggatgccattgataccgagattcttcatgacggcaaggagtatatttttattgacacggcggggctgcgcagaaagagccggatcaaggaagagctggagcgctacagcattatccggacagttaccgcagtggagcgtgccgatgtggtactggtggtcattgatgccgcagagggcgtgacggagcaggatgcgaagattgcagggattgcccacgaacgcggaaaagggattattatcgttgtaaataaatgggatgctatagagaaaaatgataagacgatgcgcgaatacgacaataagatccgccaggtgttatcctacctgtcttacgcggagattatgtatgtttccgcagagaccgggcagcgtctgaacaagctctatgagatgattgacatcgttattgaaaaccagactctgagagtggcgacaggagttctcaatgagatcatggcggaagcggtggctatgcagcagccgccgtcggacaaggggaagaggctgaagctgtattatatcacgcaggtgtccgtaaagccgccgacatttgttatatttgtaaatgataaagaattaatgcatttttcttataccagatatctggagaataagatcagagaggcatttggtttccggggaacatcgctgaaattcttcgtcagggagagaaaagaaaaggagcaatagttatggaacgtattatctgcctttgcataggatatgtctgcgggcttctgcagacaggctatcttgtggggaagatcaatcatatcgacatcagaaaagagggaagcggcaacgccggctccaccaacgcggtacgtgtcatgggttggaaagccgggcttctgacattcgccggggatgtggtgaaatgtgtggcagcgatttttattgtccgctatatttacagggggagcgagtatcttcctctcttagcgatgtatgccgggctgggggctaccctgggccacaattttccattttatctgcgctttaaaggcgggaaagggattgccgtgctggctgggctggttgtttcgacggatccgctgctggtgccgattccgcttgcggggttcctgatcgcggctgtttttacaagatacgtgtcgttgggctcactacttgcatcttcactgttttttctcgagatactactattcgggcacctgggtgaattccatatggctgccccttatacatatgagctgtatatattagtacttttgctcacaatacttgcatggtacaggcataaagcaaatatcggccggctgctttccggtacggagaacagatttggttcaggcaagaaaaaagaagcaaaataatagatttgaaaaagggaggagcattatggcaaatgtaggtgtattaggagctggcagctgggggaccgcgctgtcggttctgctctgcgagaacgggcatcaggttaccgtgtggtcaatcgacagagaggaagtaaagatgctgaccgaaaagcgggagcatgcagcgaagcttccgggcgtaaagctgccggagaatctggtggttacaaatgaactgaaagggacaatcgaaggaaaagacttcctggtgttggcggtgccgtccccgtttacaagggctacggcaaagaagatgagcccgtacgtaaaagaggggcagatcattgtggatgttgccaagggaattgaggaaactacgctgatgacgctttctcagcagattgagcaggagattccgcaggcggatgtggcggtgttgtccggtccgagccatgcggaggaagtgggcaggaagctgccgacgacctgtgtgatcggcgcaaagagcaggaagactgcggagtatctccagtccatgtttatgagccgtgtcttccgtgtctacacgagcccggatatcctggggattgagctgggtggttccttaaagaatgtcatagcgttagcggccggtattgctgacggactgggctatggggataatacaaaggcagccctgattacgagaggcattgcggaaattgcaaggctgggcgtgaagatgggcggcaagatcgagacatttaccgggctgaccgggatcggtgacctgatcgtgacctgtgccagcgtgcacagccgcaacagaaaggcggggtatctgatcgggcagggaagaaccatggaagaggcaatggaagaagtaaagatggtcgtggaaggtgtgtattccgctaaagcagccgcaaagctcgccattgaatacgatgtgccgcttccgatcgtgacgcaggttaatgcggtactatttgagggtaagaaccctgcggaggcggtagacgaactgatgctgcgggaacagaaaagtgagcatttggctctgccgtggccggacgacaaataagccgtttggtccggatgctgcacagtcaggaagcgggacagaccggaagtggaaagacgaaaccggggcgtggcgcctgcggagaaattttggcatgtaaaaaaagaaagatgcataaacccccttatctgcgcataaattggtatcagcagaacaagggggtatttttatggattcatttcagttatacaaagacatgaaagctagaacaaacggagagatttatattggagtggttggtccggttcggacaggcaagtcaacctttattaaacgttttatggatttacttgtactccccaatatgacagatgaacatgcaagagaaaggacaaaggatgaactgccccagtccgcgtccggcaccacaatcatgactacggaacccaaatttgtaccgaaggaagcggctgccatcaagctgtcggacgacgtggaagttaagatccgtctgatcgactgtgtggggtatatggtagacggagcctcagggcatattgaaaatgatacagagagacaggtgaagacaccctggtttgagtatgagattccatttaccaaagcggcagccataggcacgcagaaagtaatccacgatcatgcgacgatcggtattgtggttacaacggacgggagcatcggtgatcttccgagagaaaattacatagcggcagaagaaaagacaattaaggagctccaatcgatcggcaaaccatttatcatattgctgaatacgcagaagccttatacagatgaggcgaaagcactgaaggaagagctggaggaaaaatacggggtatctgtgctgcctgccaactgtgagcagcttcggacagaggatatccacaacattatgcgccaggtgctgtacgagttcccaatagcagaagtggagttctacattcccaaatgggtggaaatgctttcaagagaacacaggatcaaggcagatctgcttcagaatgtaaagtctgttatgggagagatgaaagatatccgcagtgcggccagcaaagccccgcagacggatagcccctacatagaccaggtgaatgtagaaaagatcgagatggataccggaagggtcaagatacggattggctttgcagaacaatattattatgaggtactcagcgagctgacaggcacagacatcaagggcgagtatgaactgatctcggccatgaaagaactggctgccatgaaagaagagtacacgcagatcaaagatgcatttgctgacgttaaaatgaagggatacggggtggtcagcccgaagaaagaggaaattgcactggatgagccgcagatcatcaagcagggcaataagtacggagtgaagatccactcagaagcaccatcgatccatatgataagagccaacatagagacagagattgcgccgattgtaggaaatgaaaaacaggcccaggatctggtagaatacatcaaagcagaaagcgagacccccgagggcgtatggggaaccaacatcttcggaaaatcgatcgaagaactggtcatggacggaatgcgtaacaaaatcaccatgatcaacgacgaaagccaggcaaaactgcaggataccatgcagaaaatagtcaacgacagcaacggaggacttgtctgcattatcatatgatggctgggagaggttagtggaggaagggggccgctgttttcccgcctcgtggggcatgaggcggtggatcgggctggctggggacgttatcgagctggatatgcggacagcagtattctggctggaggtattatgacccgcatatccagctcaatccgctgctaccgtcggaattaccacccggggagctaaccccgcgccttgaagcacatagccagcggggagagggacttccgaagggcaggggaacaagaaggggcccgatctggatgcatagaatgcgcgttagaacggcttaatggaaattctgccagatgttgaggctgaaatcggcttacaaagccgatttcaaagaggcctgagctgcataatcatcaagattatgcagtgaatgcctctgatgcctcaacatccggcaggatgtccatttagccgttcttagcaaatggacagcatccagatcgggccccttcttgttcccctgctcttcggaagtccctctccccgctggcgtacctccttctccgccgtccagctccccaaaagttcctcttgtgggatttggagggacggggtataatattttcaggtatttattttggattaatgatgaggagagtcgttatgagcagacaatttgaaaaggtgatgaagtgttatgaatactatcagtccgtaacagcatttaagccgcgtgtgggattgattcttggctccggactgggcaattatgccagaaatatgcaggtggagtgtgagattccgtacggcgatatcccgggattcccggtgtccacggtggaggggcatgacgggaggttcctgctgggatatatcgggacggtgccggttgttgttatgaagggacgggtgcactactatgaagggtattcgatcgaagatgttgtgcttcctgtcaggctgatgaagttgatggggattgaggttttgtttctgacgaatgcgtcaggcgggatcaaccggtccttccatgtaggggattttatgatgattacggatcaaatttcgaattttgttccttcgcctctgatcggtgagaatgtagcggagctgggaacccgcttcccggatatgacacacatttacgatgtggagctgatggaagtcatccggaagacggccgaagaggagaagatacagattcaggaaggggtttatgtgcagtcttcgggaccgaattttgagagtcctgctgagatcaggatgtttgcggctataggggcagatgcggtcggtatgagcactgcctgcgaagcgattactgcgcgccatgccggtgtgcgggtgtgtggaatttcctgtatttccaatatggcctgtggcattacaggggaagaactgagccatctggatgtgcaggctgtggcggacaagcgttccgaggagtttgaacggctggtaacgaaggtgatcgaaaaagtataaggtggtgtccgtgaagcggagaaaagtagatattggatggaaaaattttagataagagggataaggatatgaatattcgaatttataatgtgagaatcctgacgatggaagcaggaaaaggcattttcagaggagaggtctgggttaagggagataagattgcctatgcaggcccggttgttatggatgcgaaggaaacatgggacagggaaattgacggtcaggggaatcttctgatgcccggttttaagaatgcacatacgcattctgccatgacatttttgcgttcacatgcggacgatatgaagctggatgaatggctgaacaccagggtatttccggcagaggccaagctgacaggcgaagatatttactggcttaataagctggcaattatggaatatctgaccagcggtattacttctatttttgatatgtatatcaataagccggctggagaacgcgcggcagtagatacgggattcaggacagtgatttgtgagagcatcaatgatttcggcgggacactggaagaggtagaggctgactataagcgatataatcaggatccggacaggctggtttcctatcagttgggatttcatgcggagtatacgactgggcgggagatgatggaggggctggcagggctttccgaaaagtacaagattccggtttatgtacattgttcagagacgaaaagagaagtggaggactgccgcagcaggacaggcatgacgcctgtggcctatatggattcgctggggttgtttgcgcacggcggcggtttgttccatggcgtacatctcgatgacgctgattttgacattgttaaagagcgtgggctttatatcgtaacgaaccctgcatccaatttgaaactggcaagcggcattgcaccggtaaaacggtatctggacatggagattccggtagcaataggtacggatgggccggcaagcaataactgcttagatatgttccgtgaaatgttccttacaacggggcttcaaaaggtgctctgtgatgatgcggaagttgttcctgccctggaggttctgaagatggctacagtaaacggtgcacatgcgatgggactgccggagtgtgatatcatagcagaaggaaaaaaggccgatctgatcctcattgaccttcagcagccaaacatgcagccgatccagaatctggagaagaatctggtctatagcggaagtaaacagaatgtgaagcttacgatggtagcgggaaaagtactttacgaagatgggaaatattacctggactcaacaaaagaagaaatatttgcaagggcaaacgaatctgcacggcgcattttggggtaattatcagataattgatggcgtatgttaagagatgacgagaaataacaaaggaaaaaatgttgcttaacagaagaaatgcacgtataataaagagaatggtaaaaaccattctctttattttgcgaatattcagaaaacagacagcaaaggggtcagacccctatggaaaggagtactaatagatgaaagcagcaatttttacgttaaatacaggcttatataaagcaaaaaaggacagcgccgcagcgactgcattgaaacgcatgttggagcaggtgggatttgaggtgaaggcgtcgggagtcctgccggaggataagaaggtggcgctggcagtattgaggaggctggcagatacgggggcagtggagttgattttgactaccggggcaacgggaatacggaaaagagattgtgcgccggacgtggtgatagaagtttcagagaggcttcttccgggaattccggaggcgatccgcgcttataatatacgttattcgaaaaaagcgattctggaccgctctgcggcggggatccggaaccataccctgatggtaaatctgccggagggggcaaagtcggcgaaggagagcctggagtacattctgccggaattagtacatgttgtggagatgctgagtttatgatacggattacatatttaagccacagtggatttcttgtagagctggatacagcatatttattgttcgattattacaaaggagatctgccagagctgaatacagggaaaaagttttatgtttttgtcagtcatgcccactacgatcattttaaaaaagatatttttaaactgcgggagtatctgccggatgtatactttatcctgtccaacgatgtagagcccgatggggacggggatgtcatgtatataggccctaatgaagagcggactgtggatggctgcaagatacgtacgcttcgttctacggatgaaggcgttgcatttctggtggagtatgacgggagcattctatatcatgcaggagatcttaactggtggcattgggaggaagaaagtaaggcttacaataccatgatgcggcggaactatcagcatgagattaataaactgcatggtgttaagattgatgtggcgtttgtgcctgttgaccccaggcttggagagcagtattattggggactggactgctttatgaaacgtacagagacccgggctgtatttgccatgcacttctggggcaattacgggatatttgaccgtcttgcgctggaaaagaatacagaggaatatgcagataaaatataccggattgaaaaagaaggacaggtgtttgaactggaaaaaggcaggcagaagtcctctaagggaagtgtcaggaatactatgcagcaggagaagccttcgaaataaaggcagatcagaagaacagactaaaatatggagtgataggaaattatgcaggtaaaattatttacagacggtgccgcaagaggaaacccggacggtccggggggctatggcgccgtcctggaatatgtggacagcaagggtgttttgcacacaaaggaactgtcgcaggggtatgtaaagacaacaaataaccggatggagctgatggccgtgatcagcggactggaagcgctcaaccggccctgtactgtggctgtttattccgattcaaaatatgtggtggatgcttttaatcagcactgggtggacagctggctcaaaaaaggctggaagagaggcaagaacgaacccgtaaaaaatgtggatttatggaaacggcttctggccgcaaaatcgcagcacagagtgacattccactgggtaaaaggacacgacggacatccgcagaatgagcgatgcgacgaactggccactacggcagcagacggcagcggcctgatcgtggatgaagggctgtaacagttcaggcctgcctgaactgttacgaagggctttagcagcagaaaattttagaggatagattctggacagatatcaaaattcatagtataatatacaactgtgttaagtaagacagacaatcgcggctgcgggagctgaaaggctgcagacgaggaaagtccgggcttcacagggcaggatgccggataacgtccggtggaggtgactccaaggccagtgcaacagaaataaaccgccggggaaccccggtaagggtggaaaggcagtgtaagagactaccgcctcgctggtaacagagagggcacatgtaaaccccatccgaagcaagaccgaataaaagccacgtggcggcccgtcacgctttaggtaggtcgctcgagcctggtggcgacatcaggcctagatagatgattgtccaacgacataacccggcttatcgtcttgcttaaccacagtaataatttaagctgcaacgatcatgtgaattagattaatgataacggctgaccagataccataagaaagcaggtagtgaaatgggaatgaaagtaaatgcggagctgccgctgccggcagatttgaaggcggaatatccgctgtcggacaagatcatagcgttgaagaaaaaaagggaccaggaaatccgcgatgtttttatcggaaaatcagataaatttcttgtcctggctggcccctgttcagcggacaatgaagatgcggtatgcgagtacgtgagcaggctgtctcgggtcaatgaaaaagtatcagacagactggtgctgatcccgcgggtttataccaacaagccaaggacgacgggagaagggtacaagggaatgctccatcagccggagcctgaccaggcgccggatcttcttgcgggaatcatcgcgatccggaaaatgcatatcaggacgatagaagagagcggactgactgcggccgatgagatgctgtacccggaaaacaggagctacctggacgatattttatcttacgaggcgatcggggcccgttctgtcgagaatcagcagcaccgcctgacggccagcggtatggacattccgattggaatgaaaaatccaaccagcggtgatttttctgttatgctgaattccgtaattgccgcacagaattcccacaactttatctatcggggaatggacgtgacaacagatggaaatgaccttgcccacgtgattttaaggggcggcgttgacaaatatggcacatgtattccaaactaccattatgaagatctcgtgaggctgttggatatgtatgggaaaaaggatctccagaatccggccgcagtgatcgatgcgaaccattcaaattcaaataaacagttcaaagagcagatcagaatcgtaagcgaagtgatgcacagccgaaattacaatcctgatctgaagaaattgatcaagggtgtcatgattgagagttaccttcaggagggatgccagagtatagaatgcgacagggaatacggaaaatctatcacagacccttgtctgggctgggaagatacggaagcactgatttataaaatagcagagagctgttaagactataagtgaatcggaactgtaaggctttccgggacagaagatttatgaagtttttcaaccaggatgaaagtatctagccaggtacgtttctcctggttttctatttatcttgagatttatcctgaaagcttgggcacaactgaattcagacattatttctagaataaaacattgcattatgttacagtaggaagtatactggtaacataaacaaaattccgcttcgcggttacaaacaagaaagggggagggatggcatgccagatctagcaaacaatatagcagaacaagctgtctggatagaatttgcagaacactttaagaatcaggatacagcattggcatatttgaaggagatcttggagtgtgagaatgtatgcatgacagatttctttcaaatgagcagcaaggacgtcgaactgtattatataaatatgcgccaaaaagaagcggcaggtaagctgagtatgagtaccttgtgcaaaaagttttgggagctgcattcttttgctgcatatgccgcagatcataaagaggagttcggactgcctagagcgtttgaagattatttttacccatggctgaagaaactcaaacaacaggagaagttcgtccattcggttcctgtagaacatatggatgcgctctatcagactgtgcaggaggatctaatggcctatacaatgatatccctgatccatagagccggattgtcttccaatgaaatcgcgtccctgaagccggacagcctggcagtttatgataatggaacgtttgcatatattgagggaagagagactgtatgctatataccggaagatgcggcggatatattagaacgctatataaatgagaggaaggcgatggaatatttgttttataacagaaacggaggccccttaaataaaatgtatatcagccggatgttgaaaaaatatacacagaaggctgggattcctgcttacagtgcagaaaagatccgcaccacatgcggtacgtccatgtttgcatacggagccgggccggggcaagtggctaagcagatggggataacaaagacacagatacaaaaatatcacaatcgccaatataaagacaatctgctggtgaaggccaatgaacttgtaaagattaaggttgagccgcccatataaagaggcatagaaaataaccaatctcagcgaagcctgctgcgcctgcgaagctggtcgtagcgcccactacgcctgcgtttttgcgtctgcactctcgaaaaatcactctcaccgaaccagtaaggtattaaaatcgtcttatactagttgacaaaagcgcaacaagttactatactataatagtaacttgttgcgctttttgaaggagataaaaatgcaattaaaacaattaatagaggaatatgcagatagtgaaatcatgagaaggaaggggatctttgcaagcattttcattatacagaaccgtctgcagacagcctgtgataaactggacgaggaaatcactatgaagcaatggctgcttctggcgatggcgggaaccacagaaagccctatgtcgctcaccgatctgggccggctaatggggtgttccaggcagaatgtcaagaaaattgccaactcccttgagcagaaaggatttctcagattagagcgtcgggagggcgattccagggccgtaagcatagttttggatgagagagtgaaagcatatacggatcgtgtcggagaaatgcagcaaagcatattggaacttttgtttcgtggcttttcagatgatgaaacaagtgtgttatatcagggaatcatgaaactgcaggagaatatttcagagatagaaaaatatgtggaggatagacatggacatatataaggaaaaaaataaagtagtcgtttatacatcagaaaccggattttcaaaaaaatacgcaggatggatcgcggaggcattaaaatgtgaagccgtggacataaaagagtggaagagcaggaagccagagaactatcagacggtaatctatgggggaggcttttatgcagggaagatcaaagggttaaagaagatcaaagaacaaatgaaaaactatccggatttaagactgattgtattcggaaccggcgccaccccgatggaggcagaagagatcataaagggggcaatggatgctaattttacagcagaggaaaaaaagaagattcggacattctatttccagtccggtctaaattacgagaaaatgagcctgaaatacaaaattatgatgaaaatgttcaccgggatgatgaacaaaaaagccgataaaacagaagatgaacagatgatggcagaaatgctggcccattcatacgattttagcaaaaaagaatatataaacaaattgttggaatattctgaataaggtgcgcaaaggggtcagacccctttgcattttttttactgttttgctgtatatttttcttcgcagtacttacagcggtagatctgcttttcctcatctgtgaggacgaagacgtgatccagcccctgctcgatcgatgtgatacaacgcgggtttctgcaacggatgacattccggatctcttttggaagtgtcaggcgcttcttgtccacaatttcctcgttctggacgatgttgactgtgatgttgtgatcgataaagcccagaatgtccagatccataaagtcgatcgggcattcgattttcataatatcttttttgcccatcttgctgctcttcgcgtttttgatgatggcaacacagcagtcgagcttatcgagatgtaagtatttgtatatttccatgcttttgccggcctcgatatggtcgagcacaaagccttctgagatacggccgacatttaaagtatttttaaccatagttataacctcctctttttaatccacatggatgtccagcagagtgagtatgagcgccatacgcacgtaaactccgtactgcatctgcctgaaataagcagcccttggatcgtcatccacctcaacagatatctcattcactcttgggagtggatgaagtacatacatgtcttccggtgcgagacgcatctttttcttatccagtatatagaaatctttcattcgtacgtagtcttcttcattgaagaaacgctccttctgaaccctggtcatgtacagtatgtccagtttaggaatcgcatcatccaggcggactacttcctgataaggaatgttctgcttgtccagcacatcatggcgcatgtaatcgggtagacgtaattcttcgggagaaatcagaataaacctgattccttcataacgcactaatgcatgaatcagggagtggacggtacggccgaactttaagtccccgcagagccctattgtcatgttgttcagacgtcctttcacgtttaagatcgtaagcaggtcagtaagcgtctgcgtcggatgctgatgtccaccgtcaccggcgttgattaccgggatcgaagaatgctggcaggcaaccattggagcgccttccttgggatgccgcatggcgcagatatccgcataacaggagatcgttctgatggtatcggatacgctctcccccttcgcagccgagcttgattcggcggatgaaaatcccatgatgctgccgccaaggttcagcatagccgcttcatggctcagtcttgtacgtgtacttggttcgtaaaataaagtcgcaagctttttcccatcgcaggcatgggcatatttgtccggatgtgcctcaatatcctgtgccaggctaagcagttcgtccagttcctcaatggaaaaatccagaggactcattaagtgtctcataaataacctccttatatgccgaataggggcattcttaatctatctgtattgcagtaaatcttctatagatttacgtttgggcgcttccggattatcggcaggccagccgatggcgatcaatgctgcaagttcctgatcctcaggcagttccagaagcccggaaataccgtcttcatcgaatatccccataataacggtgccaagtccgtactcctttgcagccagacagaacgactgggtggcaattccggcgtcaaacatctgccatctgtctcctttttgggtagtataggagccatcgcgctcaaaaccggatcttcccttcagataagtaaccgcaatcagcatgggcgcctgccggataatattcgcattgtgctcaagcgtaaaatcagctgttattttttcaataatggaagaatcttcaattgcaatataacgggtaatctgggtgtttttccaggaaggagaataagatgctgcagaaacaatagaatcaatcaaagaatggtcaatgggatccggcttatacttgcggatgcttcttcgacccttaatacattcaatagtgttcatttgtaaacctccctattcaaaattctcttcaactaatcatatactaaaacaggctgattttcaacaggaattttgaaagggagtgctcctgttcgtcccagcaggaggtaaacagtaacagagagctctggcggttcaacgcaggattttctcgaacaggaggccggcgccgaaccacaggggagcataatcaaaccggatgatgccccttaaattgtattttgctttgctgtaatcccagggacacgcatggtgccttttcagaaagctgcctgagagaaactcaccgaagaaaatacagcaggtgtagactccgcctctcagaaggggatttttcccctttaacagccggcagacaggagtgagaaggcatgccgcgccgtaaatggggaacatccagatggaggttcgtccgatgagcgtaaattctctctttttaaaggagtggagggccgtaaaaatgatttccatgcaccagcccagggtgccgcagataataaatttattcttcataatgaaaagtatgtttaagaaacgtagattttatacgtgaaatgtattataatgtttcttagtttgtgcaaaggagaagtaaaaatggcaacattggaagaactgaggctgcagttggatgagattgacgaccagcttgtaaagctatatgaaaacagaatgcaggtatgtaaggaagtcggcgaactgaaggtaaatactgggagaaaggtctttgataagcagcgtgagaaggagaagctggcagatgtctctggcaaggtgacgggtgatttcaataaaaaggggatccaggaactgtttgaacagctcatgtccatgagccggaaactgcagtaccagctgctggtggaggccggggccctgggcaggctgccgtttatcgaggtagaatcactggaagggcagaatgcaagagtggtatttcagggagtagagggcgcttacagtcaggctgcaatgcagcattactttggagaaaactgcaacggatttcatgtcaggacgttccgtgaggccatggaggccatcgaggaaggatcggcagattatgccgtgcttccaatcgaaaattcttctgcaggggccgttaatgagatgtacgatcttttagtagaatttgaaaacttcatcgtaggggagacaatcatccccattacacatacgttgtcgggactgcccgggactagtttaaaccagctgcagcgggtttattccaaggcggaggcgttgatgcagacctcacgtttcctggacgagcatagtaattggcagcaaatcagcgttgtgaatacagcgattgccgctaagaagatattagaggatcaggacaggacacaggccgctgtgtgcagcgcttatgccgcaaaagtgcacgggctgtctgtcttacaggacaacatcaacgatgaaccgaacaactctaccagatttattgtggtgaccaatcaaaagattttcctgcaggacgcttccaagatcagcatttgttttgaagtgcctcacaaaagcggatcattgtaccgtatactgtcccattttatatataatgacctgaatatgaccaggatcgaatcccgtccggtggagggcaaaaactgggagtaccgtttcttcgtggacttcgagggcaatatggctcagcctgcggtcaaaaatgcaatcaggggtttaagagaagaggccagaaatctgaagattctgggtaattattagaatataaagaggaagatacaatgcggacaaatgaattaatactgtataagaatatggaatatggagatatcctgcaggatatgacctttcttatggagaattttcataatgattattataacagagaagatctgaggagcctgtttttcgagtgcatgaatgccttgctggagctttctgcgagccatgggttcgagggcaatctgtggcatacatacctggcatttcttctggccagcgatgagaatgcgtacagtacgtcttgtgaaatcgtcgggccggtgagtggaagcatcaacgaaatcgccagacatgatttcggagtatttaaagagctgtttgattacgatttcgataaaatggaagcagacttggatgtcaaatgcttctcaatcctggaaaattatcagaatgtcaatgcgcacagcaaggtttttaacaagcggatccgcgacaggatctgcggattgggccatgccctgggggatgcggggaatgtggaagcttttcaggagatcctgacgcagttttataaagaattcggtgttgggaagctgggacttcataaagctttccgggtggagcacccggaggagactggagtacagattgtaccgatcacaaatatcgctcatgtccatttggacgaccttgtgggatatgagattgcaaagaaaaaattgattgataatacgaaagcctttgtagaagggcggagagccaataactgcctgctgtacggggatgccggaaccggcaagtcttcctccatcaaagccatactgaatcagtactatggacagggcctgcgtatgattgaagtttacaaacaccagttccaggatttaaacgacgtgatcgcgcagattaaaaacagaaattataaatttatcatatacatggacgatttgtcttttgaggaatttgagattgagtataaatatctgaaagcagtcatagagggcggtttggagaaaaagcctaataatgtgctgatttacgccacttcaaaccggcgccatctggtgcgtgaaacatttaaggacaaggcggacagagatgaggaactgcataccaatgatacggtgcaggaaaagctgtctctcgtcgcacgattcggcgtgactatttattttgggtctcccgataaaaaagaatatcagcagattgtaaaagagctggcaaagcaaaatcagattgccatgccggaagatgaactgcttcttcaggcaaaccaatgggaacttacccacggcggcctgtcaggaaggacagcgcagcagtttatcgattatctgcttgggcaggaataagaaaggtaattcatgaataaaaggataaaaaacacggtatccgcactgataatgctggcagtttgtattggtacggtgaccggatgcagcgggaaactgacgccgaaaaagatgatgtcagcagtcacagaaaaccttgcggaagtaaaatcagtctccaattcattggaaatggacattgagctggaagatgtgcttgatttaacaaaaatctcaatggatatggagatggagaatacaacaaaaccgaaagccggtcatgcaaaagggtcggcggaagtgaatttcagcggtacgcaggtagcaagcgatatggagatctatcaggtgacggaaggggatgaatttgtcacatacagcagtatgtatgggcagtggagcagggaagctgcggccggttcccaaaagagtacatttaacggaaatctgttccaggaggccggggattccattgaatcctttcatatagccaaggaaacgattcaggtggaagataaagaatgttatgagatgtatggagacataagcggtgaagaactcttaaagtttatgggactggacatgatgagagcctttggtttagtagaacttccggaagaagatgcaatctcaggactttcggttccaattacgattgatatatataaagaagaaatgctccctgcacggatcattgtagacatgacggacgtcatgaatgacctgtatgataaatataataaaagcacaaatgtaaatgattttacaatcaagctttcgtatataggattcaatcaagtggaaaagatcgaagtgccccaggaagtacaacaggcatgcggtcaggcaggatagaccgcatgtatgagtgtcaggtatagaaggtttttgatgattaagaatataaaataagaatgcaaaataagaatatgaaataagaataagccctggctggatgggagactgacagtgaatcgtgtcagtctcccatccagccagggcatttttgtcttaaaggatcgtgtgataattagatatcgtgttctcctgggtggcgcatactgggatacgcgagaccaatactgcgattaggccgcgggtggcacttgcttttttaataaaacatctttcatacatgccccgttatctgaccaaagtacatatgcctgctacgccggaaaacactgcctaaagttcctgaatttgtgagatatcgctgtcaatgatcagtgagtagttggtataatatactacaaatccgggtttggcacccttgggcttcttcacatgctttttttcaacatagtctatttctaccttttctccaccccgtgctttcgagtaataagcagcgagccgtcctgcctcctcaaaggttctgtcgggaagttccccgccgtttgtctttacaatgacatgggagccgggggcatctttgacgtggaaccaccagtcattgcccacagcaaaactgaaagtaagttcatcattctgaaaattatttttccccacatacatatggaatccgtcgctggaaagataatgcagcggcgcatttttaatcttaaccttctttttcgtaaacttcctgcgcatataaccggaaccgatcagctcttccttgatctccgcaagatcttcctctgtccgggcaatatccagggctgtgcttacagaatccaaataagtgatatcgtcctgcgtctcctggacgaacctggagagcgcctcaaaagtccttttctgcttattatatttatcaaaatagcgctgcgcattctcctgaggtgtttttgcagcatccagagggatggtgaccatctcattggtatagtagttcagcgcctcaagctgccgggttccttcctgcagattgtatccataagtattgatcagttccccgtaaactctgtacttttcgcggttctttgtatcgtctagctgccggagctgcagatcgtactttttacggctgcgatccagggccgtctgcacaatatgccgcagatcggccgatttctgccggatgcgggtcagtatatttttagaggaataataggtctccagcacctgggacatagaagtaaaatctttccgggtatatccccctaaatgagccataggcagagcagagaactctttcggttccaggccgtcgtaatagatagcgggagtaaagcggccgtcctttacataagaaaagtaaatagaaaactgctcaaataattgccgcagggcctctccgctttggccttccaaagcggcagaagagtctataccggataaatagcagatctctgtggcggccgccgggcttacccctgtaaaggcagtataaatagcctttgccaggggcaggggcttcgccgtaatcttttcgataaaagcagattcaactgtggacaaaggatccgacttgtccatggtatccggaacaaaatattcccttcccggaagcacttcacgcaccgaactcatctgtgcagagacatgtttgatactgtcgatgatcatgccctcattgttacagaagataatattactgtgttttcccataatctctacgacgagatctttcctgcagagatcacccagttcatccagatgttcaatcgtaaagtgaataatacgctccagctttggctggtaaatatcaacgatccgtccattactgatatgctttctcaggagcatacagaaattcggagcggtcataggactgggtttggtggactccgtcagatatatgaggggaagggacgcgctagcagatatacacagccttttctgtcctgacggtgtcttaatggagagaagcaattcgtccgtctcgggctgggcaattttggctatccttccattgagcagctgttctttcaattcgtggaccagagaggccacggtaattccatcaaatgccatggtgtattcctttcttcagatgtatgtcttcttaaaacaatattttaatattgtaccataaacaagaagttcttgaaacccccatcaggaattagcggcgagctttagtctcggtgcggatgaagggggaggcggatggaatgggctatgcgtatcatgcattctctcaatgatccgtacacaacttgttcttacagacctatatactcacgggtaaaaagcgttcaaaaacttacgctgatataacagaagcaccagttctgtcccatccgccgctaccgtacggaggcccaccgggaaatgagctcttaactaccgtttggatgcaacagctcccggactcacctcgtcattcgcgtccccatccgtcaacgagtctaaagctcgttaaccatatcccgaatttattgtgtacagaggttgaccgcagagccccaagagaggtataatgtttcataatgtgtatgaaacaaactattactgtacaagaaggaagaataatcatgataaagagcatgactggttttggcaggtctgaagtacaaaaagagtccagaaagtttacggtagagcttaaaggcgtgaaccaccgttatctggatgtgaacatcagaatgccgaaaaaacttaatttttttgaaacatctatacggtctctgttaaagaagtatgcaaacaggggcaagattgatatattcattacctatgaagatacgtccgagaatcaggtttccctcaaatataatgcctccctggcggcagagtatctgaaatatctgaaacagatggaggaggagttcggcctggagaatgatgttcgtgtgtccacattgtcgcgctatccggaagtgatcacgatggaagagcagtgtgaggacgaggaagaactctggaacgggctggaagaagcgctgaaaggggcatttttacagtttgtagagacccggacgaatgagggggagaaccttagaaacgatatactggaaaagctggacggcatggagaagctggtggcttatattgaagagcgttctccggagattattgcagaataccgatccaagctggagacaaaggttcacgaacttctggcggatacgcagattgaagaaagccgtatcgctgcggaagtgattctttttgccgacaagatctgtacggatgaagaagtagtacgcctgaaaagccatatcggacacatgagggatacccttggggaaaaggaaggaatcggcagaaagctggacttcatagcccaggagatgaaccgtgaggcgaatacaattttgtccaaggccaatgatctggaagtttccaattgtgcgatcggtctgaagacggagattgaaaaggtccgcgagcagatacagaatattgagtaaaggatgtcagttatgaacagaaaaggaattctgatagtagtatccgggttttcaggagccggcaagggaactttgatgaaagcgctgctggcgcgttatgaagaatactatgcactttcgatctcggcaactacacgccagccgaggacgggggaaacagacggaagagaatattttttcaaaacaaaagaagaatttgaaaaaatgattgcgaaaggagagcttatagagtatgctaggtatgtggaaaattattatggaacaccgcgtgcctatgttgaaaagcaactcaatacaggaagggatgtgattctggagatcgagatccagggcgccctgaaagtaaagaaggcatttcccgagaccctgcttttgtttgtgacacctccgacggcagccgagctgaagaaccggcttgtgggacggggaacggagacaatggaggtcattgaatccagaatgaagcgggcagtagaggaagcggagggcatggacagatatgattatctgattgtcaatgatgaactggaagcctgtgtggaagagatgcatgcgatcattcaggcggagcatcggagaagttttcgcaatacggaatttatgaaaaaaataaaagaagatttgaataagagtttgaaaggagaatcataagatatgctgcatccatcttacacagatttaatgaaggtcgtaaacaaagacgttgaggaaggcgagacaaagattgtaaacagccgttattccatcgtacttgcaacatcgaagagggcaagacagctgattgacggagaactgcctcttgtgaatgcaagaagcgaagagaagccgctctcaacggcaatcgaagaattgaatgaaggaaagctgaagattatcgctgaaaatgcagaagaagaataagtaataaaaagggcagatgcactaggggtatctgccttttatgaatatctgccggacatagaaaggcgccggcaaagcagaatacgggagggtttatgaagatactatttatttctctggggtgcgataagaacctggtggatacggaggtcatgctggggcttctggcatccaggggatatcagatgacggatgatgaaacagaggcggatattatcgtgatcaatacatgctgttttattcatgatgccaaagaggagagcatccagaacattttggagatggccgaatataaaaaggacggctctctgaaggcgcttgtggtgacagggtgtctggcagaacgctaccgccaggagatacttgatgagatcccggaggtagacgcggtactgggaactacatcctatgataagatcctggaagccgtggacggagctctgaaagggaagcattctgttacgatgtccgacattaacgggattccggatgtggaggcaaagcgtcttgtgacaacaggaggtcattttgcttatctgaagattgcagaagggtgcgacaaacactgtacttattgtattattccaaagattcgggggaattttcgaagcattccgatggaaaagctaataacagaagcacagtatctggcggaccagggggtgaaggaattgattctggtggcacaggagacgacactttacggtatagatatttacggagaaaagtcgctgcatctactgttaaaagagctgtgcagaatacaggggatccgctggatacgggtactttactgctatccggaggagattacggacgaactgattcaggttatgaaggaggaagagaagatatgccattacctggatcttccgattcagcacgccaatgatgacatcctgaaaaggatgggcagaagaacctccaaacaggaattgactgacataatccaaaaactgcgaagagagattcctgatatctgtcttaggacgaccctgattaccggtttccccggggaaacagcggagcagcacgaggaacttatggaattcgtggatgagatggagtttgaccgtctgggagtcttcacatattcaccggaggaggacacgccggcagcgcttatgccggatcagattgacgagaaggttaaagcggagcggcaggccgatctgatggaacttcagcaggagatcgccttcgacaatgcggaaagtatgatcggcagggaagtgctggttatgatcgaaggtaaggtggcggatgaaaatgcctatgtgggcaggacttaccgggatgccccgaatgtggacggacttatttttgttaatacggaagaagagctgatgtcaggagattttgccaaagtcagcgtatccggcgcagtagaatatgatttgataggaggtcttgtgtaatgaatttaccaaataaacttactattttgagggtgattatggttcccttttttgtcctgtttatgcttacggacatcgggggatcagcaaataaatggatttccctcatacttttcgtggtagccagcctgacggacctgctggatgggaaaattgcaagaaaatataatctggttacgaattttggcaaattcatggatcccctggcggacaagcttcttgtctgctctgccatgatctgcctgatcgaaatgaataaactggatgcttggatcgtaatcgtgatcatcagccgggaattcattatcagcggattccggctggtagcatccgacagcggagttgttattgcggcgagctactggggcaagttcaagactgtattccagatggctatgattatcgtcctgatcgcagatctgggcggcttctttgacatgctcggcattgtactggtgtgggctgcactggcgctcacaatcatttccctgctggattacgtgtttaaaaataaacaggttctgacacagggagggatgtaggatgtatccggaatgggtattgaataaaatacgtgaagagggaaggagcctggaagagtgtctcgtggaaaagctggcggcagaaaagctgaccataaccacggcggaatcctgtaccggcggtctgatcgcagggacgattgtcaatgtggcaggagcctctgatgtgctgaacgaggggtatgtaacttattccaatgaggcaaaggaaaggctggtgggtgtcagccacgagacactggaagcttatggcgcagtcagtgagcagactgcacgggagatggcagaaggagctgctaaggcggctcatgcggatgtggctctcagctctaccggaatcgcaggacctggcggaggaactgcagataaaccggtgggtctggtctatgtggggtgctgcgtcttcggaaaaacaaaggttatgaaatgccagttttccggtgacagggcagaaaacagggcagacactgtgaaagaagcgctttcccttgcactgtctcttttgcaggacgagggatcaaataataattcacttactgtctaataaatattcacaggccgctgttctggaatgccaatggatttatccggcaattgcagaacagcggcctttcctatgtgttgactaatttattggggctgcatgctctttggctttaactccagcatggctgcgtaatgtttcacgcagaatgtttcgggtgcaatcttttccagcaaagtcctgtgctccgtttcccactctgtaatttcttccggggttaaagatgctccgacgccgcggcaggccttcattcttccgttccagcttttcctggtaaagggaacctcaatatcatattcctcatgataaactgcttcgaaggtttcatagataatatccggcacggctatcggatgttttctctcgcccgcccccgaccacttggggctgtacttcagtaccagcttttcactcgcaccggcaatctcatcctcaaacggcagccatgccatgtataacagcagaagtcttccgtcctttttcagcatacgggctaattttggcaccactttcttatggtcaaaataccagaaacactggcaagcggttatgacatcaaatgaatggtccgcaaacgcaagctcttccgtggctgcagcgtagtattgaatgtcctggtttaattcggcagacattctttgcgcctctgcaacctgcttttctgaaatatccgttcctgtccattttgcaccataccgatacatatttctcggaagcacaccggttcccgtaccaatatctaatactttctgcctgtttaaacataagttccgttctatgactttctcataaaaaacctgtggataaatatcccggtatctggcatagtcagctgatgtcttaccccagtcaaatgcttttccggaatctattttctcgttgcttatctccatgtgaactgcctccattttcttcctgagaatcctcggaaactcttcctgaatgatcttttacatttaagtatactactgtattcttcttattactattgaaaagtttagcacggaccgaagcaaagaccagatgccccgaggtcatcacttcattggctccgatgccgtgcagggggggccgcggcatggtccgaacagcagcaaaaacctcacataaatttcacagaacacggcggattatttaaggttcagctaaagtaacaactttatactacgaaagaagtcaactattaaacagtaattgaaaggacagattgttgtatgaaaaaaagatatgcaggtgttttacttgggataacaataactttgggatcgactttgctgagcggatgtgcagataaagaaaatacatcagatacagcacagacaatatacggacaggtgagtgagataagcggaggaactataaccatagaagtcggtacacaaaaagaaatggaaattccggatgatatcgaaaagtcagatgatacggaaaagccggatgatatggaggcgggagagatgccacgggacagcgggcagccttctatgctggattttaccggcgaggagcaggatattaaagtggaggctgacacagtgataaagcgtcagagtatgggcggcggaaaaccgggggaattgggggaagcgccggagggcggtacacctgaaacacaggaatccggtggggaacaatctgccgacagaaccaatggggctgtacagccggcagaggaagaaggcagtgagaggccatcggaagaaaaaccagatggagccccggatggagaagcgccggaagaatcccaggaggagataacgctggatgacattgaggaaggggataccattgcagtgactttagatgaggatggaagtgtctctgagattcttgtgatgtcctcgggcggtatgggtcagctggacggtgtagagagctatagtgcggcagaagaatttacggaagatatcgagaaagatggggagagcattacatccacagggacggatgagaatgcagctcatatttttgaaggagcctccgttgtcatgaaaaacatgaccataacaaggtcgtcaactgacagcacaggcggtgacaattccagtttttatggtgtgggcgcggcagtgctgaatacggacggggtgacttacatcagtggaagcacgattgagacagacgcggcaggaggcgcaggtatttttgcctatggaaatgggacaatatacgcctcggacacgaaaattactgcaaaacaggatacctcaggtggaatccatgcggcaggaggcggtaccctgtatgcctgggatatggaagttgatacatcaggggagtcttcggcagcgatacgaagtgaccggggcggtgggaaaatggtcatagacggaggaaactatacctcaaatggcgtgggatctccagcagtatatagtacggccgatattgcagccagtaatgcgaaccttacggctaacggatcggaagctgtctgcattgaaggactgaattcactccatctgtatgactgtagcctgacaggaaatatgagtgatgatgaacaaaatgactgctcctggaatgtgattctgtaccagagtatgtccggtgactcagaggcaggaaacagtacttacgagatgaagaacggaacacttacagcccaaaatggtggaatgttctatacaacaaatacggaatctacgatcactctgtccggggtagatatacaatatgcggatgacagtgaatttttccttcgctgtacaggaaacaacaaccagagaggctggggggctgaaggggaaaatggcgctgactgtctatttacggcggtcagccaggccatggaaggcgatattatttgggacagcatcagtaaactggacttctatataacggagggcagtacactaactggtgcaattctggatgatgagacctatgccaaagacggcggggatggttattgcaatctatacattgacgaagaaagtacctggacggtaacgaaggacagcgtgatgagcgccctttcctgtgccggtactgttcaggactcagacggaaaaaccgtgaccataaaggacagtgacggaaccgtgtatgtgaagggcgacagcagtctgcaggtaacagtggacacatatgacggaaacggggatgtctccggcgcatctgctgtgacagcatggtccgattatgagaccgaaaagccatcacagatataattggaaaatatgaggagcggactgacaggaggaaaagatggagaatcaaaataaagagataaagctgccgtcctgtattggtggcattcaaaaatcaggcagattcaaaaagttaagaaagaaaaaaatattttgggcaggagtattgactgttggattagtgacagttattgtagcgggggttttgttccgcaatcaggcatcagaaaacaaggctgccgggatgactgtgcagtcggccacagcatccacagggagcattagtactacggtggtgggtacgggaacactggcagagggatcagccactgatgtagtagtaccggtaggcattaaagtaaaagaagtgctggtagagagcggcgatacagtgaaagaggggcaagagctggctactctggatgaggcatccatcgccagccagcttctggaggtgaaggaaagtattgaaagtgtagaagaagaaatcaatgatctgtctgaagaggcacagacagcaggaacaacagaatatctggaatcaaaagtactgaacggtcagctggaggaactaaaagaagcgcaggccacgttgaatacgcttctggaatcaaaagtcattaccgcatcctgcgcaggtacaatcagcagtatcaatgccgctgcggatacggtaatcacacaggcatcggggagtactgccggttcggcatcaggagccagcagcacatcggtctcggtagcggggagtagctcctcagccgggacatcgtcggaaagtaaaactatgagtatgccagggacggcatctgccagtcaggcaagtatgatgtatcttaccgcggatattacacaaaccgaatcaagtactactgaccaggctgacacagacggttctgcggtagtcagcacagccgaggaaagcgaaagctccgccgcggagaaaagcggaggggacgagatccgtattgagtcctgcgatgtgaaggtatcagctcctgtgaccggagaaaaaccgcaggcagaaatacaagcaacggatgagtatacaggaactattacatggaattgttcgacggaagccttcctggaaaaaacggtgtatactgcaaccataaagctgacagcgaaagagggatatgttttctcaggtaatattctgccggaaattcaaggtgcggatgtgtccttcgaggtgcttacagatgatgatggaaatagtatattaagaattaaggcaaaatttgcaaagaccgcagcggataaagacgcggaacaatcgggtgcagaccagccgtcagaaaacaacgggattgcccagaacggaggcagtacctcggacgcagcatccggtacagacagcagccaggtatccggactggacaaaggcagttcaggcggcacggaaaataacgggaacagcactgcagacggagcaaacacgcaaagtggaggaactactactaccggaaccggccagagtacggcggcagcttctaatgattcaggaagctccggcggcagttcttcagacggaacttcatcgtccgattacagtgcctatgaggcggcagcattttccatagcaagtcctgacgagacggtcgtatcaattaatgtagacgaactggatattctctctgttgaaaagggacagacggctgtcatcacattagatgcgctggaaaaccaggaattcgagggaacgataacgaaagtctctgccacgtcctccagcgggagcagcagcgccaaatatccggtagaaatcacgatgaaaaagacggatgacatgaagcttggcatgagtgtttctgcaataattcagattgatgaatctaaggatgcggtactcattcccgtaaacgctcttcaggagaaggggaatagtacttttgtctatacaggcacggatgaagacggaaatccgaccggtgagacagaggttgagacaggtctttccgacggaagccaggtggaaattatcagcggcctcaaaagcggtgataccgtgtattacctgaaagcagagagttcagacagcggttttgatatgtcccaggatatgatgggcggcttcgggcaggataggtccggtggagaaatgccgtcaggcggcatgcctgagggcggtcccgacggtttcgatttttcaaaatagcggagggactaaaatatgattgtgttaaatgatgtttcgaaaatataccaaatcggtgagtctgaggtttatgcgctggaccatgccagtatgcgggtcggggaaggggaatttgtcagtatcataggcccttccgggagcgggaaatcgaccatgatgaatattatcggctgtctcgatatggcagacagcggacagtatctgctggatggacagccgatcgaggagtatacggagacagagctggcaaaaatcagaagccgaaagatcggattcattttccagagctttaacctgataggaaatatgacggcggcagaaaatatagaactgccgctgatctatcagaagattcccagagaagagcggaaagagcgggtggcacaggctcttgaaaaggttcgtctggcgggccgcggcagacataaacctaatgaactgtccggaggacagcagcagagagttgccattgccagggcaattgcatccaggccgtctcttttcctggccgatgagccgaccggcaatctggattctgcaaccggaaaagagattatggaactgttccatggcctgcacaggcagggcagtaccattgtcctgatcacgcatgacgattccatagcaagacaggcagaccggagcgtccatatcctggacgggaagatcagggaggtggcacgatgatagcgcaatcaatgaaaatggcatggaaatctatttcctctaataaaatgcgctcctttctgactatgctggggattatcataggagtgatttccctggtcgtactggtatctctggtcagtggaacaacggaatcagtgagcagccagatttccagtatgggcaacaatcttctgacagtatctgtaaaggatgacaaaggcaatcctatgaagctagcggatgttacggttctggcggaggacgaagaaatcagggaagcggcgccggtggcacagagcagtgttacggcttccagtacttattcagaagaaactgccagcatatacggcacaacaggggcgtatgccgatatacaggacttagagctgtatgcgggcagatttctgaagaatacggatgtagaaaaccatacgaacgtggcagttatcaatgcagggcttgcaacggatgtattgggcagaatgaacgtggtaggcgaaacggtcagcctgaacggcgtggactatgagattatcggcgtgctcgccgccagagacagtgattcgaccacaattcaaaactatgaggcctacatcccgtatacgtctttgatccgtttaacggaagacgtatcatcgaatatcacctcattttgtgtatccgcctccagagaagacacgctggatcatgcagaagctgttctgacagagaccatgatggaacggttcagccaggatgaggatgcatttacaatcgtgaaccagtcaacaatcatggaggcaatggaaagtgtgaataatacactggcacttttgcttggtggtattgcagcaatatcgcttgtagtaggagggattggcattatgaatattatgctcgtatcggtaacagaaagaacccgggaaatcgggattcgcaaggcgatcggcgcggacagagggacgataatgctgcagtttctcatagaagcgctgatgctcagcctgcttggatgtgtaataggaattctgctgtcatggggcatattgcagattatttctgcggcaggagatagtgatgcggtatataaactgtcagtcagtgtggtgtggatttccatagctttttccatgggtatcggggtggtatttggaatttatccggcaaataaagcggccaagaaacggccgattgatgctttgaggtatacaggataaacaaatagaaaagaacttcaggggttactgtgcagaccgtgccgtgcaccccgctgcacggcatcggagccgatgaagtgatggtctcggggcatctgcagcagaagaaggagctcttcttcctctttgattataatatgaggacggagagcttcctttgattactgatgcagagcaaatgttgtctgaaaaatgcgtccatctacctctaaacttgtagaatcttacaattgacgaaagttgaaaattatgcgaaaatatgacatatatggcgttaaataaatatcaagcgcatataggatgaaaatcatacatatttgaaaggagttttaacatgatttattcacatgaagtagaaatgatgtgtccggtagcccagggtacaaatcacggaccagctccaattccggaagaagcaaaatgggtacaggctaaagagattaaagatatttctggtttgacacacggtgtaggctggtgtgcgcctcagcagggtacatgtaaactgactttaaatgttaaagatggtatcattcaggaagctttagttgagacaatcggatgttcaggaatgacacattcagcagctatggcatctgagatcctcccgggaaaaactattttagaagcacttaacacagaccttgtctgtgatgctatcaatacagcaatgagagaacttttcttacagatcgtttatggaagaacacagagtgcgttctcagaagatggacttccgatcggcgccggcctggaagacttaggaaaaggcctccgttctcaggttggtacaatgtacggaacacttgcaaaaggtcctcgttacctggagatggctgaaggttatgtaacaggaatcgcgctggatgaaaacgatgagattattggttatcagtttgtgagccttggtaagttaacagacttcatcaaagcaggcgatacaccgaacgatgcgtgggaaaaagcaaaaggccagtatggacgagttgctgacgctgtgaagatcatcgacccacgtaaagaatagccggcacaggcggagtgcgcgccgcatggattctgtccatgtgctgtgcttagctaggtgtcatataggtaacgttagaataaatcaggaggacaattaaatggctttatttgaatcatatgaaagaagaattgataaaatcaatgaagtattaaatagctatggcattgcttctattgaagaggcagaaaagattacaaaggatgccggacttgatgtttacaatcaggtaaaaggaatccagccaatctgttttgagaacgcatgctgggcatacatcgtaggtgcagcaatcgcaatcaaaaaaggctgtaagacagcagctgacgcagcggcagcgatcggagaaggacttcagtctttctgtatcccgggttctgtagcagatcagcgtaaggtaggtcttggccacggtaacttaggaaagatgcttctggaagaagacacagactgtttcgcattcctggcaggacacgaatcttttgcagcagcggaaggtgcaatcggtattgctgagaaagcaaacaaagttcgccagaaaccgttgcgtgttatcctgaacggtcttggaaaagatgctgcaaaggttatttccagaatcaatggattcacatatgtccagacagaatatgattactatacaggagaactcaaagaagttcagagaacagcttattcagacggactccgcgcaaaggttaactgctacggcgcaaatgatgtgcgtgagggtgttgcaatcatgcacaaagaaggcgtagacgtgtccatcacaggaaactctaccaacccgactcgtttccagcatccggttgcaggtacatataaaaaagaatgtatcgagcagggcaagaagtacttctccgtagcatcaggcggcggtacaggtcgtacacttcatccggacaacatggccgcaggcccggcttcctacggtatgacagatactttgggacgtatgcactctgacgctcagtttgcaggatcctcttccgtaccggcacacgtagagatgatgggactgatcggggcaggtaacaatccgatggtcggaatgacggtggctgtagcggtcagcatcgaggaggctgctaaagaaggcaagttctaagaaaacagagaaagaaaactggattaaaaatatgattaggagtggtcagggcatgaatatgcagaccactcctatacttttttggcagtattatgatagcaccatagagtcttcagagtttcagagcaggaaacttgtcagagagaccggtttattgcaatttgtcgaaaaacatgatatactgttaccggtattttagcatgatatatacgttggatttgctttaagtaatcatatacttggcagattaatatgaatgattaaagtgaggtgaggacggatgccgactgcagaagacagggagcggaacatggaaaatgcaatccaggccgcaattaactgttttgagacagtaggaatatcgaattgtacacgggaaatgattgcagaaaagtcagggttgagcacacgttcacttcagcgttattttggtacattaaacaatttaattaaagaagctacgaagcgttattcccagaactttaatgaacgttatgaagaaatgttccattcctattcagtggaaggcagggacggattgacacaattagaatttgccctccgtatgcacgtttacctcttccaaccgaatatgccctctgttattgtcatgcaggaaatcgataattattggacaaggttagatgaagttccctatgaattactttccccatatatcgaaaccaaaaggcatgggcgaaaaagaatgaaatatagttttgtttatggtctcttggaagagggaattgaagatggaagcattcgtgccgatctggatttgaatttgacatatttgtggatatcctcatcttttacaggaatgctatatcgtattggaagagaacctgagttatataataatgaggataatatctctgcgaaagaaattattaatggttatgttgctgctgtactggatgcaattagatcttagctagttaaaatagtcgtctaatgacgactattttctaaattttctgtgtcctacaataagccacaaaaaacttgttgtattttagtggtatgtataaaacgatctgaagaggaggtaaaaataaaagatattagaaaaaggaataaaattgaaataaatggacaaagaattcaccttcagttattgatagttaatccatttggtgtgtcagatttaacggaaggcagagaggaaaagaattatggaaaataaacttatattgaatcactatagtgtgtgttttgacgatagtccatgtgcgttctgcttgttagctccggccaaaaatgcattcggaataactattgattttcgttttgtctatgtaaataaagcagtagctgaactaatggggattgcactggagcagatgcaggacaaccttttttacacagtttttcctaatgcaggtaaaaaatggctgatacttcttggaaaagcagtagatgaaagaaccactggaactttgtcagagtttaacccgacgaaagagcaatatctgcaaatccgatattacagtccggagtccgggtactgtgcctgctgtatacaggaaattactaatcatcaaagaaacgccgatcggttgcatgcagttattgatatttttgagggcggatttggcatcattgagcgcagccctgatggtaaatattatctggattttgtcagtggcggattatgccgcatgcttaaaatacctttttcaaaagttaagcaggattgcgatcaagatatctgcgcacttatccgcgatgaagataggtcaagttacaaatcaatgttagatgaaaacgcaaaagaaggtgctatgttctataagatatttcgaatgaatacagaagatggccgaaatcttaagattgctgtacgtggaattactaaaagcttcggaaataaactttgttattatatcagctttacagatgtaacagaaaaaatagaggctaagcttctggcaaagaagactggaattgaaatgcagaatattatcaatgccattccgggcggcgtagctatttacaggatttcagatgttgttgaaataagttatttttcagacggcgtgccggttctaacaggacatactatagacgagtatcaggaactgattggtcaggatgctactatattgatccatcctgcggataaagagatgctggctcgtgagattcacaaagtatgtaaatatgacacagtaatggattgtgaattgcgtaagcggcatagaaatggtcatgtggtatgggttcatcttcaggggagaaaaataggagaagataagggagcaccattgatacaatgcatttatcataatattacaagacaaaaggaaacagaaatcgctctgctggaaaataaagtgatatcagatattgctcttaaaaatgcggatgtgaatatttggacctatgatattacgactcacgcattgattcagacaattcaatcggaaaagctgtatccgggggcaggaacagaaatacctgattttgtagaaaacaccattaaaaatggacatataaagtcagaaagcattgaggattttcgggaattatatcgtttggtagaagcaggagagtcagaggtctgcaaagatatatggatgacaagtaaagaaggagaaggctggttatgcgagcggatatattataccaatcttaaagatcataaaggtaatgtactgaaaactattggagtaggaaaaaatataaccaaagaaacaaaagtgctgattgagaaacaacagatagatctggcaatagcatcaacagagatttttttatgcacctatgatatacaaaatgatgtttttattagctttagccctggtgcaaatcggttagggtttcatgctgaacagagatgcagctattcaaataggattcaatgtgggtatattatgccggacagcacggcggaatacacgaatctttatgaatctttagctaaaggagtgaatccagttaacgctgttatacactacaataaagaaaaattaggggttgagtgggtccgcattacatattcagtgatttttgatgattatggaaagccgataattggtgtggcattaggggaagatataaccgagtttgttcttgctaaaaggaaatttgatgaagaaatgaaaaatttagaggcaatccaaagtaattctcttttaggaaaatgtcgtgctaatgtcagtaaagatttagtagataattatacctgcgacagccgcatgatatattctaacgaaagcaatagttattcagatgccatagaagtagtagcacttcagtgtgaaacggccgggatgaaagacgaatacctaagtaaaatgaatgcaggaagcctaattaaattttatgagtccggaaagcagagctttacatttgagtataaaagaagaatggcagacaaccagttttattgggttaggactatcatcaatacctttgaaaatccagaaaatggcgatattatgtgtttcatgtacacctatgatatccatgaagaaaaacagcttgcaactatagtggaacgaattgtagatcaggaatatgaatttttagggctgcttaatattgacacgcagcaattaagctgctatcactattctgaattggaagaggagatggaaatcggcattaatgtggattatagatatggtttgccagagtttgtacataaatttatacctgatgaatatcaaaataatgcaataaatatgctggggagcaaatatgttgaacagcagcttcagatgcaggatacttttatctgtgtttttcctattgtgttcaagggaaaaaaacgtatgaaaaaatggcagtttatgtatttagattcaagcagaaacgtggttatatttacaagaaccgatatatccactattactgaacagcaggaacagcatcaggaagtacttaagaatgcattattgcaggcagaacaggcaaatgtggctaaaacagagtttttatccagaatgagtcatgaaatcaggacgcctatgaatgccattatcggaatgtcaaaattggctgctcagtatgtaaatgatcctgaacggatttctgattgccttgccaaggtggagatttcggcccgctttcttttgtcactcattaatgatattttagatatgagccgtatcgagagcgggaaggttactttaaaaaatgaagaaatccccttcgaagagtttttaaacagcgttaatacaatggcttatgaattagctgcggatcaaggagtagagtatgactgtattgtgacaaactttacagaagacttttatgcaggtgactccatgaagatacagcaggtacttattaatctaatttctaatgctataaagtttactccggccggaggaaaagtacagtttatggttcaacaacttcacttagaatctgataaagcgctcatgcgctttacagtaagcgatacggggattggcattagtgatcaatttaaagaaaggatgtttgaaccatttgagcaggaacgtacaggaattacaaacccatatggcgggacagggttaggcctggcaatttgtaaaaatcttgtggatattatgggagggacaatttcagtcaatagcacagaaggaattggttcagagtttcatgttgaaattagccttggggttagaagtaaaacaatgaaaaggccgcaaatccaatatgaaatgaacggaaataatctgacggctacgggggtggatctgcaagcagagactcctagggagtttgattttactggcaggcggatattattggtggaggatcatgtactgaacatagaagtcgcaaagcaattgcttaatgcgaaaggatgggaagtggaggttgctgaaaacggattaaaggcggttgaagcttttacgctttcaacgcaggggtattttgatgcaatactgatggatattcgtatgccaattatggatggactaacagctgccagagcaattcgaaagttaaagaaaaaatccgcacagagcataccgattatcgctatgagtgcgaatgcttttgatgaagatatcgaaaaatcaaaagcagcaggaatgaatgcccatttagcaaaacccatagaaccagaattactgtatgcaactttggaggaatatttaaattgatagtcaaaagcagaaaatgttttttgtttggtattctgctgcaagtgttatttgtacgaaagcaatagtgaattataatgagaataaatatagaaattgttctgagctattaggaaacaaacataggctgaaaaaaatgtaagataaatgtaaggttataataatgttagtgtcaggtacccttgataccatagagacatcgaaaggagatgtatttatggattatattatttcaacggatcagctgacgaaaagttataaaaggtttaccgccgtcaatcatgtctcgcttcacattcaaaagggtacaatttacggattcctcggcccgaacggtgcaggcaagtctacgactatgaaaatgctgctggggctgaccgcgcctacagggggaagcttcagcatcgccggaaaacattttccggagaaccgtctagagattctgaaacaaacaggttccttcatcgagtcgccttctttctatgccaatctgacgggccgtgaaaatttggatattgtcaggcggattttggaactgccggaaaatgcggtagaggacgcactggaattggtaggcctgacggaattcggtgaccgtctggccaaaaaatattcgcttgggatgaaacagcggcttgggcttgcaggtgcacttcttggcaggccgccgattctcatcttagatgagccgaccaatggccttgatccatccggcatacatgaaatccgcaatctggtcagatcacttcccgagctctacgactgtacaattctgatttcatcccatatgctgtctgaaatcgaattaatagcggatgacatagggattcttaatcatgggtgccttttatttgaaggaagtctggttgatttgaaacagagcgcgctgcaggccggatatgccgcagaaaatcttgaagagatgtttcttgcaatgatcgataaagacaatgcgtccagaaagaagagggcaaagttatgagaatgctggcaattgaactccggaaagaaaaacgaaccggtgtgattcccgtgctgctggcggtgggcgccctgggtgcgctatatgctcttgctaactttttagtgagaaaagatacgctgctgaacctgcccctggagccaatggatgttttgctgacccagctttacggtatgctcatggtcctcaatatgtttggtatcgttgtggcggcctgtatgatctataacatggagtttaaaggcagtgccgtcaaaaagatgtatatgctgccagtgaacgtcccaggtatgtatctgtgtaaattttttatgataacaatcctgtttttagcagcaattgtgttgcagaatctggcgctcctgcaaatcgggaggacagagctgccgccggggacttttgaattgtttacactgatacgatttgctgcatattcatttatcacatctatgccggtactggcatttatggtattaatatcttcccgctttgaaaatatgtggattccgctgggcataggagtagccggttttttgagcgggatggctctggcaaatgggaagtcggagctgctgatgattcatccatttgtggtaatgctcaagcctgcagttgctatgagtgccagaccggatataatggtgatgctagtctcaatggctgagacactgctttttcttggtgccggaatgtggatggcaaaaatactgcgctatgagtaaggaggaatgtgcaaatgactttttgggaattgatcaaaatcgagtttatgaaagtaaaacgttcaaaaatgattcccctgatttttaccgcccctctgctggtggtggctacagggatcgctaatataagcagctatttcacaccggagtacacgaatgcatggtcagcgatgttcatgcagagtgcgcttgtctatgcctactatttgctgccattttccatgatggttgtctgtgtcatgattgggggtcgggaaatgcagaacaatggaattttaaaaatgctggcactgccagtcggacggcatgcactgtctttagcgaaattttttgtactggtgttttatctctttatggaaatggtggttttccttgtggtttttgcagcagccggccagattgctgtgcggacatcgggaattacagaaacgatgccgatactctatctgctgaaatggtgtgcgggcctgtttctcactatgctcccatcaattgcggctatgtgggccgttacagtactatttgagaaaccgattctctgcgttggcctgaatctgcttcttgtaattccaggggttttggccgccaatacgccgctttggattgtctatccttactgctacagcggatatctggtatcctgctcgcttcatgcttttacaacgcaggcatcagatactgtgttttccatatttccgttcctgccgtgggcggttctgattttcctgctggctcttgcactggccgtcactgggtttgggaagaaagaaatgaaataagtacagagaataatagaagtgcgtcagatttaggaatcggagacaaacggataaacgaaaaatctgcattgcagcagacagcgtaaggtgttaaaatgatgctgtcaggaagaggcattaacaggatgaaggaggcatttattatgaagacggaaagagtagagaatatgtgcggaggagaaggacatgtcataatcaaacacattctcggagaaacagaattaaacggaaaatgcggactatatgcagaagtaacactggagcctgggtgtactctcggataccacgaacatctgggggaaagtgagacttattatattctctcgggtgaagggatgtacgatgataatgggagcagccgtgcggtaaaggccggggatgttacctttacaccggatcactgcggacatgcgctggcgaatacggggcttgaagatcttgtatttatggctttgattattaaaggataggggcggagcaaaacgcaggaaacgggcggatgctgtcaggaagagagcataggaatgtctggaggtggggaccggctgtcctgctggtttactttgacggtattttaaccataggcaacgttcaaatgtccattatatcaccagggggcagaaaaacggcaggtaatagtaatggacattttgcgttcgtatataaaactacaggaatactggattgagattatatttataatcttgttaattcatatgtctgcgtacgagacaggagattacacctgcgagacacaggccgagcagtatattatgaagggagccgaatacgtccagggctccttttattccgttaagaattgccagggaacctaaggtgtctggcagaaatgagcacaacaggaacgaaagataggatgcaatataaatgaagataaaggagaacaggcctctgcccgtatcctctttgtaaactttccgtccttcacggatccgcatctttgtcatcgaccagaacagggcaatcagttcaaacagaagaaaaacagcggcaacagccgcgtaggcggccagggcgtagtttttttctgtcaggatggtttgaggatcgccgtaaggtgcagcgccgcgccagaaattataggcgagtacgccaaaagtcccggcagttataagcagggatacaattctgactacggaacgggcaacacgatagatcccttttgttccgtatttcgccgtttttttgacaggagagagcaggcaggatacgttcgggcctgcattttttctgcgccgccggggggcatccctgtagcctccgctggagcggctgtcataatcatcgtctatataatcactgcgtgaacacctgccataatcattatccctgtaatcgctgcgtgaacggcggccatagcggttatcgatgtcatattcctcatcctcgtaatcatcgctgtcatagtattccacgtcgaagtcatctgaatcgtaatcatcagtatatccgtcgtccataccgtcatagctgtctacataacggttttgatacacgccttccgtattcatggaaggcggttccggacgcctgccgggcatgcttcggtaatccggggcatccagtactaccgtcgcatcggataattgtttcgttgtctgtttggtatcaaagctatatgtgaaagggacatcttcttcatatgtcacttcaaaatcgtcatcaaagaatgtgctattcttctttgcagtgctcatgcagatcctcctcaaatgtcaatattactggtggtcattgtataacttttttcatgtatactcaagtgataacatcaaaaattcataaagttctaagaaatctttcatattttttccaaaagtggtagaatggaaaatgttgtggcgccaactagtacatcgtaaaataaggttagcttatgaggcagttaattattatacgatgtactaatacatgatacgaaagacgggagtgatactttatgataacagatatgacagtaggaaaaccatcaggggttctctggaaatttacgattccgatgctggtaagcgtcatgttccagcagctgtataatatagtagacagtattgttgcaggcaagttcgtaggcgtgaatgcactggctgcggtcggggcatcttatccgattaccatgatatttatggcagttgcgaccgggcttaatatcgggtgctccgtcgtcatttccttgtattttggagcaaaggaatatagacagatgaaaagcgctgtcagcacttctctgctgacggtcctgggaatcggcgctctgctgaccgcattggggcttatattcagtaggccgttgatggttctcttaaagactccgggagacattttcggcgattcggcgctttatcttaacatatacataggcgggctgatcttcctgtttctgtataatatctgcacgggagtatttaccgccctgggcgattccaggacgccgctgtactttcttatcgcttcttcgctggggaatatcgttctggacttggtgtttgtgatcaactttcatatgggcgtaagcggagtggcgtgggctacatttctggcacaggggctgtcctcattcctggcatttattacattaaggaagcgcctgaaggcagtggaaagcctaaaatacaagctgttttctggttctatgttgaaaaagatcatggagatttctgttccaagcattctgcagcagagctttatctccgtcggaaatttgtttgtgcaaggtctgatcaacagttatggttctgcggtggtagccgggtattctgcgggaatgaagatcaatacctttgcaatcacgtcttttacgacgctgggaaatggtttgtccagttttacagcacagaatactggggcacagaagacggaacgtgttgcgaagggattccgctccggtgtgtttatggttctgagtgtggccgttcctgtgtttctgcttttctttttctgtggaaggcccattgtacagctgtttatgagtgaaggtggagaacaggctgcggatgtaggcgtggaatttttaaagattgtctcgccgttctacatgatcatatccttaaaattaatctcggacggtattctgagaggtgcgggagcaatgaaggcattcatggcggccactttttcagatcttatcctgcgtgtcgtgctcgcctatttattctctggaatttggggggccacaggaatttggctgtcctggcccgtgggctggctgattggaaccgcattgtccctgggattttatttctcgggagtgtggaagaagagcaggctgatataaaatggaggaggccggcggtgcatgggggtgcatcgccggcctcctctttatcaatcaaagggttcgaaaaaggcttaataaaactcctgtcagctgcctgtgcgccgatcctgcagccagtccatgccaagcagcgccaggattatgagaaatccaaggataaaacagagcagtatccaggggatcggttccagccacagggcatttgataaatagttcgataagataatttcataataaataatcaagaaagcgatcagataaatagcataagctttcagcataacttttgcttttgctatatagagatcacgtctggaaaccggaagcgtgtcatactttctgagaagaaatgttaagcgccccctctcgcggatccagaataaacggcggttcagataaaacatctccagcacgattccgatccagaatgcggagtggccaaacgataccggtgaatccggcgccagtatcacactatccccaacacccattccggcattcatggcgctgatctgcatcgatgtttcgctctggacctgcatgaaaaagaagtacatgcaggctgccatgataaaatagtgataaccgatgcggatgcgagctttttctttttgataaaggttcataccatcgtcctccttctttatatcaggataataaatcacggatgcgaaatcgctcaaacgaggcatccggcgctttcctttttgggtcagtgttcctgtgctgatcctccaggacttcacgggtgttattttgtaccagctttccatccttaagtacaaggacataatcagccaatttgtccagatcttctgtaatatgcgtagagagcaggattccgatatttttgtttaaaatatcctgcatcatagcaagaaaatcccttcggaataccggatcaaaaccggccataggctcatccaggagcaaaaagcgcgggcggtgggccagggcgaaacagaattgcatcttcatcatttcccccttggacagctgataaagcggctttgaaggggggagttccattttatccagataggtatagaaatcttccatggaccagtcagagaaaaatgtgcccagcagatgtccgttttccaatatagagctttccagataaaaagatagtgtctcggatacaaagccgatcttctccttatacttttccggttcgctgcgcagcgaaatcccgtcaatagaagcgtctcccgtgaaattgcgggcggccccggaaatacaatggaataacgttgtcttacctgagccgttcgggccgatcagtgccgtaagatacccgctctccagccggaaagagatgtcttccaaggtgaaattcttatattttttattgatgcctgcacactcaaatacggtcatctgaatcctcacttccttcccaaagtatctgtatcatatcctgaaactgggcacaggtcaaatcaagacgccgcccttctttgacgcattctgtcacagcgtcctcaaggcgtttcagctgttcttcccgaagcgcttctctgtcaggttcttttacaaagaatccttttccctgctgggagtaaatcaggcccccggcctccaggtcttcataggcgcgttttgtggtaatgacactgatccctagatctctggcaagagaacggatggagggaagcatgctgccagggagcagttctccgtttaatatggaattttttacggcctgtacgatctgttcatatataggcaggctggaatcttcttttataaatatattcaaagggctcactcctttttatccggaagaggatagtacattttctcataagagagcatataggaaaggataggggaactgcaccgcacggcaatcagggcattgactgcaaagagcagcatccatacaaggaatatccagtggttccatgttatgtgtgtaacggcgagcgtatagaatacaatgttttctacgatcagcagtgcaaaccagtatactcctgcaatgacttcctcgcttttttcagtgaccatatcaggcgctgcctccagcgcctctttccggtttcccgggtctgtgcgcaggttcagcgccagaatcaggaaaaaccataatccaagctggacaaccatctccatccagcctcccaagaggaagaaacgtccggacataaacagctgtaccaggatggtgagcagcaggcttaagatgacttttacgacaaggtgaaagcggagataatgcattttttctttttcgcccacggcacagacgtaaagaggcatggcaagccggattggcatttttctcaaaaccagccataaaaacaggattgtcgcaacggctgtgatcgatacggcagcggcttggagcgttggggaggactccatggcggcaagtatctcagcgctgtaatccttgccggatatctgaagatccctcaagaactgaaccagtgcgatctgtacacccagaattacaatcacagcgtatacgataaagtacagaataaaggttaaaaagtttctcttaacatccagccataaatcatttaagataatccggatcatttgataaaaccccctttgctaagataatacatcagatcatccagtgtcggccttgctgtttccagttccagcagctgtccttcccgcggatattcaataagcagggagctacggtatgcttcgtggagacgacagatcacattggcgccgaaaaggtgttcaatctgttcccgggtaccatatgcgatatagaatctttcatttaattcctctttatccagctggaggcagaggctgccgttatccataagggcgatataatctccaatctgatctaaatcggaagtaaggtgggtggaaaacaggatgctgcgtgtgccgttctctacgatatcctgcatataaccaagcagttctctgcgaaatagaggatccaggccagcagagggttcatccatcaggaaaagctttgcatcatgggagagtgcaaaggccagctgaaaccgggtcttctgtcctttggaaagtttcccggccttctgcctgggggatatttcaaatctgctgcagaacttcagaaacagtgcatggtcataccgggaatacagggaaccgaaagatttcccgtttgtttcaacggtaagattgtcttcaaagggtgattcatccagtacgaagccaatgtcatcctttgcccggcgctcctgggtgtccatggaatgcccgttgatgaagacctccccgctgtctttctgatagaggcgcaggattgtcttgatcagggaggtttttcctgcgccgttcctgccgatcagtcccatgatatatccaggttccagtgtaagattaatatctgtgagttttaaacttccaattgttttgttcagatttttgatttcaagcagattgtccatagcgatcctcctgactgtgaatcttactgtatatatactgtgtatgtttatatatacagtataccctaaatatatatttgtcaataggggaatacaaaatataagtgatgggaaataataacagaaaacagaaaggaaatgaagaagaatgaatgttcaaaaatgtggaattatcggatgcggcggcgtaggcgccacaaccgcatatacactggtggaaagcggattgttcaatgaaatggtcctgattgatattgacaggcgcaaggcggaaggagaggccctggacatcgggcacggtattccgtttaccgtcccctctgatatctatgccggagattacgaggatcttaaagatgcatatctggttgtggtgacggcaggtgctaatcagatgccgggtgagacaaggctggatatctccgctaagaatgcaaaggttttccgacagatcatcccggaaattgtaaaatacaattccgagtgtattctgctgattgtgacaaatccggtagatatcctaaccagtctggcgctgaagctgtctggttttccggccagccgggtaatcggaagcggaaccgtgctggataccgcaagactcaaatatcttttgggcaagaagttcaatttggattaccgaaatatccatgcatggatgatcggagaacacggtgacagcgagcttgcagtctggagcagcgcaacggtggcaggccttcctgtagacgaatactgccgccagcacgggcgaacccgcgacagccttcagctcaatgaaatatacgaagaagtccgcgacagcgcttatgagattatagacagaaaaggctctactttctatgctgtcgcgatggcagtaaaaagaatcgcccaggcgctggtgcgtgatgagcattcgattatgacagtctccagcctggctcagggtcattacgggctcaatcacgtctgtattggcctgcctactgtggtaggaagaaatggggcggaggatattatagagatccctctgaatgcacaggaaaaagatgctttgagtgagtcggcacaggggcttcagaaaattatggaatctttgtagagaggggacgctttgaaaccgggaagccttgcacctggcgggagcatatatgccattttaaaaatcggctccgtttacgtaagaatccctaaaggaaaaaacatagaaaatggcggtccagcggcatgcaacccgaaatttggtaatttcgggtcttaggccgcttcagaatttgccgtgagacggcaaattctgcccaccgttttctatgttctttccttaagggattctaacgtaaactctaggacttttaaaatggcatatatgctcccgccaggtgcaaggcttcccggttttaaagctggtgcatccgggcggtagggatgggacgttcaccgggtgggggctaagcggtggaggcttattgaatcgtttggtggaacgtgatggtttaggtaggatggcggggctgtttgcgccgggagctttgccaggaagattcttgtttatgggctgggatgctggtataattatggtaaaatgttggtaggagggcagatttatgaaagttttgatgctgaatggaagctgtaacttgaagggatgtacatacacggctttggaggagatcggaagggtgcttttggatgagggcgtggattatgagatttttcagattggggcgaaaccggtcagggactgtcttgggtgcggcaggtgcagggatggaaaatgtgtttttacggacgatggagtaaatgagtttgtggaaaaggcctatgaggcggacgggtttgtattcgggtctccggtttattatgcgcatccaagcggacggatcctttcgtttctggacagggcattttatgggaatagcagtgatgaacgctgcagggcatttaagtataagccgggggcggctatcgtatccgcacggcggggcggaacaacggcctcactggatgcaatccagaagtatttcgggattgcgcagatgcccacggttgggtctacttactggaatatggtgcacgggcagaaaccggaggatgtcatgaaagacgaagagggactgcagacaatgcgtaatataggaaggaatatggcctggatggtgaagtgttttgcggctggaaagcaggaggggattgcgcttccaaagacggaactagcgtattctacgaattttataagggaagtataggtaaatagcacagtgaaggccgtgttttttagcagaaatgaaaactatttgtaatgatttaatgtgttggcgcagcatcccaaaaagtttattgacgtattttggaaaatcccttatgattattaggtcgaaaggggatgctgagtctaatgaatgttttgaatatagagcatataagtaagatatttggagataaggtcatatttgatgacgtatcgtatgggatacatgatggtgataaaattgggattatagggattaatgggacaggaaagacaacactgcttaaaattattgctggcctcgaagagccggatgaggggcaggttgttaagcagaatggcttaaaaatgaattatctgcggcaggatcaggaatttccggaaggtgcaaccgtgctgtcctatgtaagttcagggaagaagcaggaggaatgggatgcggataatgaggctaaaagtattttgaacagccttggcattacagatcatgatgctgtcatagagcctctttccggtggtcagaaaaagcgggtggctcttgcgcgcgcgcttgtttctgaagcggatatccttcttcttgacgagccgaccaaccacttggatgaggagaccgtgaactggctggaagattatcttaaacgctaccggggggttgtgattatggtaacccatgacagatattttctggataaggtaacgaacaaaattttggagatcagccgtggaagtctgtacggatatgacgcgaattataccggttttctggagctgaaagcccagcgtgaggagatggatctggcgagcgaaagaaaacgccagagtgtgctgcgtgtggaactggaatgggccagacgtggctgccgggcgaggagcacgaaacaaagagcacgtctggagcgtctggaggcgctgaaaagagggacggctccggttcaggatcagacggtggaattggaatccatggaaaccaggatggggaagaaaacgattgaacttcatcatatcagtaaaggttttggggacaggaaactcatcgaggattttgactatattttcctgaagaatcagaggatcggaattattggtgaaaacggctgcggaaaatcaaccttaattaagatgattgcgggtctgattgagcccgatacagggagcattgaaatcggagaaaccgttaagatcggttactttgcccaggaagagcaggacatggatgatggcctgagggtgattgattttgtgaaagagatcgcagaatatattccgactagggaagggcggattagtgcgtctcaaatgctggagcgttttttgtttactcctgatatgcagtatgcacccattggtaaattgtccggcggggagaagcggaggctgtatctgctgaaaattctgtgttccggcattaataccctctgtctggatgaaccgggaaattccctggatatcccaacactgacgattctggaagattatctgaattcatttcccgggattgtgatcacagtatcccatgaccggtatttcctggacaatgtggctgaccgtatctttgcctttgaaaacggacatttagtacaatatgagggaggctacacagattacctggaggcgaaaaagaataagggggcggcggaaacagaccataatacatctgggaaagagcaggaagataagaaccaggcatacaaagagtggaagcagaaccgcccatcaaaattaaagttttcctataaggaacagaaagaatacgaatccattgatgaggatatcgcggcgctggaagagaagatagagtcgctgaatgccaacattatggcaaatgctactaattccgggaaattaaatgagctgatggctcagaaaagccaggcggaaacagaactggaagaaaagatggagcggtgggtatacttaaatgatctggcagagagaatagaagagcaaaaaaacacataatcatgaatagcccccgtctgttttcccctaaagtggagccgtcctaccgcattgaagaaccggctgcagaggaaacggatatgtggtgtggcagggcatagaataagtattactgccccttaaggaaatacagcctgattttatggaaccagagagattcacttagctgtcttgatgacagctaagctcagctctctttgaaatttttttcggtgaaaaaatttcatccataaaatcaggctgtatttccttaaggggcagtaatacttattctatgccctgccacaccacatatccgtttcctctgcagcgtcccctcatcgccaattcgtccccactttccaaaccatctatttatatgttataattatttaatgcattgacccggactacattaggaagtataatattacatgtgattaacaaaacgaaagaaaagataacaaacgcagatacgtgtgattatttttaaattatatgtgattatatagttcgggaaatcttgtgatataagtgatagaaggagaagaagcatggaaaaaccagtacttgtgatcatggcggcaggaatgggaagccgttatggcggtttgaaacagattgacccggtggatgaggaaggccatattattattgacttttctatttttgatgccaggagggcgggatttgagaaagtcgtttttataataaaggaagaaaacaaagaagaatttaaaacttgcattggagacagaatcagcgaatatatggaagtagtctatgtgtttcagaagctggatgatcttccggagggatatgaggtgcctgctggacgtgtgaagccgttcgggacggggcatgcagttttatgctgcaggaatgtgatcgatggcccttttgctgttatcaacgcggatgattattacggcgtacatgcgctggaggagatttaccgttatctttcggaacatgcggatgatgaaaaatacaggtatgccatggtggggtaccggctggataatactttaacagataatggatatgtatccaggggaatctgtgagacggatgaagaggactatctgaccggaattattgaacggactcatattgagcgaacaacgaacggaattgaatatacagaggatgatggaaagacatggaacaagatcgacaagaactgtatcgtatctctgaatatgtttggctttacgaatagtttattgagagagctggaggagcggttcccggtatttctggagaagaacctgaaggtatcacctttgaagtgtgaatattttttgccgtcggtggtaggtgaacttcttgatgaggataaggcgactgtgaaggtgttgaaatccgaggacagatggtatgggatcacatataaggaagataagcagagtgttgtggatgcggttgcagagatgaagggaaagggaatctatcccctacatctctggaaataaacaggcatacggcatcagacaacagtcagagaagaacagcagacagaaaggaaaaggtgagtataatggcagttttagtagcaggcggcgcagggtatataggaagtcatacatgtgtggaactcttagagagaggctatgatgtggtagtcgtggataacctctacaattccagtgagaaagcgctagagagagtgcagaagattgcagggaaggaactgaagttttatagaggtgatattttgaacagggaggacctggaacccatatttgggcaggaagatattgaagcggttatcaacttcgccggactgaaagcagtgggcgagtccgtggtgaagccctgggaatattatcacaacaatattaccggaacgttaattctatgcgatgtgatgcgcagacatggctgcaagaacataatattcagttcttccgcaaccgtatatggagatcctgcagagattccgattacggagaagtgcccgaagggggaaatcaccaatccgtacggacagacgaaaggcatgctggaacagattcttacggatctgcataccggggatccggagtggaatattatgcttctgcgttactttaatccgatcggagcgcacgaatccggactgataggggaagacccgaagggaatcccgaataatctggttccttatattgcgcaggtggcagttggaaagttggactgtctcggcgtgtttggcgacgattacgatacccatgacggtacgggcgtccgtgattatatacacgttgtggatctggctgtgggccatgtgaaagcgatcgagaagatgaagagcagcaaaggggtgcatatctataatctgggaaccgggacagggtacagtgttctggatgtcgtaaaggcatatgaaaaggcgtgcggcaaatctatcccctatcagatcaagccccggcgcgcaggagacatcgccacttgttactgtgatgcatccagggcaaaagaggaactgggctggactgccgagagaggaattgaggagatgtgtgcggattcatggaaatggcagtcgatgaatccgaatggttacagggacagtgaatagatgaaaaagtgaacaggagaaaggtgtaatgtgcgcagaaggtaaattaacagatgtggaatacctgccattgtcctgcagccagatgaatatctggaatctggaaatggcacacccgggactcccgattaacaacatatgtacggcacttaagattgaagggaatctgaatctggaatatcttcagacatgtattgagcttgtatacagggcatttccgtctctcaggacaagaattaccatcagggacgggcagccttatcagtatgtgacagaagagatacctgccagaacggcgttttttgattttacagagacaaatgagcagggggtgggaatctggtttcagtccgttgccagagagcactttacactgtatgattctccgctgtgccagatggtgatttttaagacttcagggaagagcgggggaattctgaccagggtacatcatatcatagcagacgcctggtctcatgcattgattacaaatcatatcatacataattatttccaacttcttcagggaggcagggcggacagttttgcggcaccttcgtatgaagatcatatcttaagtgagcaaaagtatctggagtccaaagcttttgaaaaggataaaaaatactggaggggggtgctcaatggtatcctgccagcggcggccaaggaatatcagtgtccggtcataagccctgtggggctcagaaagtcgtaccggctttctaaccggctgaaccggcttattggagggttctgctcgaagaataaagtatctccgtttgctgttttctatatgggcctggcagtctatctgcggcgtatgaaagggctggaacgtttctgtgtcggtgtgcctaccattaacaggcttaattttcaagataagcagaccggtggtatgttcgtcaataccctgccttttgtaaatgaactggatatttccatgacgtggaacgagttcaatgaaaagctgcaggacgactggtttgcgctgctctgtcatcagcgaattccattcgaatctataaaaaaaatagttagccaaaacggcgggaatatatcggaatctttgtttgatatcgtattgtcctatcagaacggaaagatggaccacctgcaaggtgcaagagtttctctggagggccggtggctgtacagcggttatcagagcgaagctctctgcatccacctaagcagcagagatcaggaaaaccaatatacggtagattatgattacctgacccagatattttcagaagaggaaattgaccggctgcatgagagcctatcccggattcttaaggaggctctgcagaacccggacgttccgatcgccggccttcagatcttaagtgaggagatggaagagcaggtcatctacggcttcaatcagacagatgtttggtataacagggatgtgggaatcgcagaccagttgttagagaccttccggctgaatcccgggagagcggcggttatatttgaaggcagaaggatatcctatcaggaactggaagagtactccctgaagaccgcgcgtgggattgtgggaagaaccggggacagaaaaggaactgtggctgtccatatgagaaggacggagaagatatttacggcgctgtgcgggattattctttccggaaacagctggcttctgattgacagggaattgcctgcacagcggaaacgagagatggtgtgtgacagccaggctcttttctgcatatgcacagaacctgcagaggagatgtccggctgtgtagatctggttcagttagatgagctggcagatgcggatgaaatgccagactgtgaaacgacagaatataaagcgtccgggccggatgacctggcatatctggtttacacgtcgggcagcacagggacgccgaaggccgtggaagtggagcagcacagtgtgctgaatctggcggcggcgatgcagccgctctatccaaagggcgccgttctctcgatttgcagcgtgggatttgacgcatttttactggagagtgtgattgcccttctttgcggccggacaattgtgctggcctcagaggcggagatgaaccacccacagaggctgggcagcctgattcaaaattatgacgccggatttatggcgttgacgccgtcccgtttatctgcatatttgaagaatgcagatttctgtgattcactgatgcatatggagacggtgatctgcgggggagagagcctgccatccgaactatctaaaaagcttgcggatcatacatgtgcggcgctgtataaccagtacggcccttccgaggcggcagttgcggtcagccatgctgtggttaacggcagagagtccgttcatataggccggcctctgcagaactgcaggatctatattctggatgaattccagaatccactccccccgggatccgccggagaactatatattgccggtgattgtctggcgaggggataccacaacagagaggcgcttacaaaagagcgttttatacgcgatccctttcgggacggcgggcgtatgtaccgaacaggggattatggtaaatggtcaaaagacggtaaaatcttttatttgggcagaagggatgaccaggtaaaactgctcggacaccgaattgaactttccgagatcgaatccgttctcatgcggcatgagaaggtagaggccgcggcggctgggatatgggagaacaggctgatcgcctattatacaggggatgtccagcttacggaaagcgaactgcttacatttgcatctaactatctgccgcggtatcttctgccggcggcggtggccagagtggatgcttttccacttaacaataacgggaaaatcgatttcacggcccttgagaagcctgtattatcaggcggcggggattccccggcagatgaagtggaagaaaaactgctggctgtctggcggaaagtactggaacgggaggaactagacgttcactctgattattttctgtcgggaggggattcactgaatgccgtactgatgcttttggaagtagagaaacagttttcccggagcattaccgtacaggagctgtacgcgaatgcaacactgagacggctgggcaatcttatcagaggcagagagatccgtccggaagcacagcgcgcggagatccggagagcttcggtgaggaactggtatccggttacaccgtcacaggcaggattttacgttatgcaacagctggatgaaacgaagatcggctataatatgccaactgtgttccatctcagcgaatggctggattatccgcggcttgagcgcgcatttgccaggatgatagcggaggatacttctctgcggactacatttcatattgaaggcggccgggtaattgccagagtcagccccgggacggagtttcggatgcagtggatggagtgcggcaccatagaagaggcgatggcaagctttgtcagaccctttgatctgacggaaggaccgcttcttcgggcagctatgctaaagctgccggggaatgaaccatatctgctgctggatatgcaccatatcatctccgatggcttaagcagccagctactgctgggcaggctgaaccagtattaccaggaacttccggtatccatgccggagctggattatattgattatgcctggtgggttagtgaaagaaacagccaggaagaaaatccgtgcagggcattctggcggaaacacctgccggaaaagctgccggagcgggagcttacgcccgacaggcccaggcctcctgtatttgacggggcagggggacagtacgagtttgcccttcccccagccctgagtgagaggatcgcaggcttttgtgaggaacagcatgttacggtcttcgtattccttctggccgtctatggacttttcctgagccggtattccggaagcacggaagttgtggcagggacgccgttttccggccgccgtcggcagcacatggaggagatgacaggcgtgtttgtccagtctcttccggtttttatgcaggccggggctgtggagacatttacagcttatctggaatcggtaaaacagacggtttcggggatgctggatcatcaggagattaccctggaagaactgcttgaaatcaccaaaacttcgaggacaagagaccggaatcctttgttcagcgtgatgtttactatgacgcctgtgaaaagcggggatataacgatcggaaatgcaaagcttgcctacattcccagcgatacgcatgccgtgaagatggatctgaatctcgaggccgtgtatctgcagggaagatatcatttccggtttgagtacgccaggagcttgtttgacgaggtgacgatcgcattttacagcagatgttatctgcagggacttaaggaagtgctgcagaatccggaggcgctgctttcggagatttccatgctggataaggcggatcaatacagactgctggatcagcccgtgcgcctcaggacgccttatgatgcgacaacggtggatcaggccgccgattattatgcctatgcggatccggatcgtactgccgtacagtggggaaacgactcctgttatacttttggggagctgaaggagaaaaccgatgctctggcgggaatactgagggctgagggaatcggccggggagataaggtagcttttctgacgaagagaacggggctgctgccagtttttatgttcggtattttgaaatccggtgcggcttatgtcccgatcgatccggaatttccgggggagaggattctttatatgctgacgcaggccggtgtcaggctggtgctttatggacagcaggaactggttctggggaatctgccctgcagggaactggtctgggatggacgggaagcgggatctgttttggaggtaccggctgcagagcatggagctcaggatgcggcaaacgtgatctttacttccggaaccacagggaagccgaagggcgtggttatgtgccacaaatctctgtcaaatctgctggcgcatctggaacctctgctgggagaccgggaggaaaagatcctgtgtgcatccaactgcgtctttgatgtgtttacgacggagacgatactggcgcttggaaaagggtatgcggtcagtgttgccgatgaggaggagatgctgcttccatggaagatggcggagcggatccggcgtgaccaagttacggtgcttcagctgacgccctcgagaattcagatgtgtctgggagatgaagcattctgcggggcattgcgtgggatacaccggattatccttctgggtgagccgtggagtatggagttaaaagacaggctgaacggtctgacagatgcccggatcttcaatatttatggtccgacggagacttccgtgcacaactgccagggggatattacggatgagaaaagtatccatatcggaaagcccatcggaaactgccggtattatctgctggatgaagaacgccgccccgtaccgcccacagccgtcggggaaatctatattgcaggggaatgcctgtcaccggggtatatcaacaggcaggatctgacggatcaggccttcctgccggatccatttctaaaaggagaaaagatgtacagaaccggagaccggggaaggctcagagccgacggaaactggcagtgccttggccgggtggatactcagattaaactgaacggacaccggatcgagccactggagattacgcagattatgctgcagtcggggctggtaaaggaggcggccgctgtgcctgtcctgcatcagggcgcggtgcgtttcctcagggccgcggtagtcaaagcggagggatatacggaagagttactcagggcatatatgaagaagaagcttccggactatatgatcccttcagagatccatgtgcttgaggaattaccaagaacggccagcggcaagacagatctaaaaaaactggcggagacagaggcggaggtgcagacggccgaagccggggaatcagggattgctgagttgtggaaagaagtgctgggacgggagcctcttcgggacgtatcgttctttgaacagggcgggacctcgcttcaggcgattcttattttaaatcgttatcaccagaaagagtatgattttggtatcaatgatttttatcgttgtccaacgctggaagaacaggagaaaatgctctgccccgtgcccggtaaagagagagaaacggcggttccagcgcaaaaagaaacactctgggaactgccggctgtgctttcagaccaggaagaaaggatgtgcaggcccgggaatatatttctgactggctgcacaggctatctgggaagttatatattgaaaaaactgttggaatacggcagcgagaaaatgtactgtctggtaagaggcgggatggtccggctggaggaaagcatgaattattacttcggcgccggttatcttgataaatataaagaacgtctttatgcgtttgacggagaactgacggcggaacagtttcaggcggatccatgcgtttatgaggagatggtgcatagtgttacgcggatattccactgtgcggcggacgtccggcattatgcgccggaagaagaacttatcaacacgaatgttgagggcacccggcaggtgctgcgctttgcagaggcttccggagctgcagtgatgtatatatccacaatcagtgttgcaggaatgcagacggcccggacaaaggaacagggagcagtgctgtcagagaaggatctgaatatcggccagaattggtgggagaatccctatgtcaagagtaaaattatggcggagaaactggtagacgatgcggtacggcggggccttggtgctaatatcttccggatcggaaggctggtctccagttcctttgacgggatattccagaaaaatccggaatcgaatgcattttacaggctgatcaaaggggtgatagaactggggatgcttccggagattctgtaccaccataggctggaggtaaccccggtcaatctggcggcggaggcggttattagactgagcaaaacaacaaagtccgcctatcatatctgcagcccccataagattgaaatcggctgcctggctgaggcgtgtaaagccgtgcagataacggacgcagagacgtttgcagggacactcaaagaaaagagcatgcggtcggactccccgtatatccaggcattagcacagacctggtttgaactgcagaaccgggaggccgaagtggtgccagatacggcgtttacacagaaaactctggctgcactggacttctggtggcctcagccggacatcggaaaactgaaactatgctttacaaaagaagaggggagggaagagcgacaatgacaatagccgggcatatactggatatatcggcagccgtactggggtttttcattgtcagctgcctgatgaagggcaggctgtcggcagcacagaagctgtatctttcctcggccggatttctgctgatctggctgctggcaatcattgggatggagtacaccgagaatatggcggcgctgcaggtcatggatgcaattacatgtgcctgttccgccatgctcattatgaccatactgctgatttccctgatctttacgagaaatcaggtaaaggtaccgcggcactactggcttttgtatgtgctgccggtgctctcgtctctagttgtatttacaaatccgctgcatcatttgttttacaggaagttttccatctacgcatcggaagtaaggtttggccctttgtttatcatctcggggctgcagtactatatttattctattatcgtagtaatcatcatgttccggtatggaatcaggcgcaggaccagaagtgtatgggggcaggtggggctgtttatcggagggctgtttgttccgttcttcacgaatcttctggcaacccttaagattgtagacctgcccatatctgctacaccgctggcctttctgatcactatattgtgccatgggattgccgtgtactacttgaattttttaaatatcaaaccggtggctctggaaaacatggtggataacgtttcagagggatacgtcattctttcctctgacagatgcattatttattcaaacgctgcatttgatgaagtattcggggaacagtataacatgaagattaacagttatctgaatcaggtagttgagggactggaggagcggaaacgagatgtgatttacaacttgcttaatttttttgatgtatgcaaacagtctgtaaatgttatctcttatgaacaggcgattctgtgtgaagaaggcaaggtctattattcggtagaacttacacccatttttgtaaagcacagcatggccggagttctggcaatgttccgggatgtgacaaaactgaaagaggaaataaaaagaaaacagcagaatctgagccgggcaatggagagagaacggctgatctcactcggacagatgattggaagtatttcccacaaccttaagactccgattatggctatatcgggggatgtgacgattctagaggacttagtgagggagtattcccagagtgtaggagacccggaggttacgattgaagatcatcaggaaattgcaggggagatggagggatggctggccaggattcaggaatgctgtgcttatatgtcagacatcataacgacggtaaagggtatggctacaaatttaagtacatcctcggaggaggattttacaatggatgaagtgttcaaaagagtggaaatgtttctgaagggcaagctggtcaaaaatggctgcagactgattacggataacaggcttttagagaacactgtgatacaaggggatatcaataatctggtccaggtagtcaataatcttttggacaatgcatgtgatgccatggaggggaagggcggagacattgaactcagggcctggaaaaaggacggcagtgtctatattgctgtgaaggatcatggtatgggtatctcggcagatgtgagggaaaaactgttccgcttaatgtgtacaacaaaaggaacgaaaggaaccggactgggtctgtacagctcggcggagattatacgggcacggttcggcggcaggatatggggtgagaataacgaagaaggaggagcatccttctatgtcgagctcccagtcgaggaagacaggagaggataaagggaatgcggaagaacagagctggaaaagaaaaaaatggttttaaaatgttcattttggacgatgacagaaatattctggatgctttgagtgccaatttccgcacaaaaggctacgaagtagagacacaggaaaatccgctgacagcattggaacagctgaagaacggccgctatgatattctgattttggactttatcatgtccccaatctgtggggatgaggtggttgcgcggctgagaaagttcgataccagaatctatgtaatcatgctgaccgggcataaagaactggcgcccccgttaaacacgatccgggagctggcgattcagggatactgtgagaagagcagccggtatgaccagctggaacttcttgtggaaagctgtgtgaaatgcatccggcatatcaatacaatctaccggtatcaggacgggctgtccagtattctggacgcgataccccacctgcaccagatggtgcctgtcgatgagctgtgcggtcaggtgctgaaggagctgaaggctctggtacagacaggggatggctttgtgtgggtgaaaccagatggcgtactgacggatccgggaaatgccgaactgccggcggatatatacagaggggccggctcttacgataagccattttttgagtttgagaatgaggatttcccggtaattgtagaacatgttagaaagagtatggcggagcagcggattatctatcataatggagtcctgcttgtgcctctccttggaaaacgggagatcattctgggtgtcatgggagcgaaaaccgggaccgcaccggatactacgctggaggcgctcttgtcggtgtatgcggagcaggtatccacagcccttcacaatacactactgaaaatgttgttaaatgccaacaataagaggctctccggcatgaataagcggctgatggacagctatatgcagacggtagaggcactcaggctgctggtggatgccaaggatctctacacaagagggcattccgaccgggtatcctattatgcggtgaaacttgcggaacgcctggaatctgacgcggaatttgtgaaacgggtcagggtagcaggacttctgcatgacattgggaagatcggtgtatcggacgcagtgcttagcaaaccggaacggctaagcgaggaggaattcagagagatcagaaagcatcctggcatgggcgccaatattctgtcctgtatggatatgttcagcaatacgggagagattgtgtgtgcgcatcatgagcgctatgacgggacgggttatcccagaaagctgaagggggaagaaattccgccggaggctaggatcatagcaattgcggacgcatttgacgcgatgatgtccgatcggcattacagaaaaaaactctcatttgcagaggctgtgagccagctgaaagaggggaagggcgcccagtttgacggccattatgtggatgtatttctggaagtactgaaggattatgatacaatcagtgagcagctgcgatggacttatgatgaaaataaaggaagaaaagaaaattatggagcagaagaatatttataaacaggtaaaactttataaaaccctgccggagtgcctccttgacgtgcaggatgcatatgcggagagaccggctatcacgtctttcgacagggcgggtacccaacgggatgtttcttaccgtgaatttgtaaaagatgtgcagggagccgcctatatgatggtacagaaaaaaatggcgggtaaacacattgccctggtgggcgaaaatacttatgaatggattgctgcattctgcgcggccggctgcatcggttccgtgggagtgccgatcgacgtggaacagccggaggaagaaatcctgaatctggctgaatttgcggatgcttcttacacggtagtgcaaaaagattttaaagctgcgttccagggatggaaaaaagaacgtgtgatctgtatggacaccggaatccgggagatgatggaagagggcagaagaaaagtggagcaggaacagatccagggattttcatttgcccaggacatcgggccggatacaacgctggcaattgtatatacgtcaggaacaaccagtgtttccaaagccgtagtacttagccattataatatgatgtatgatgcctgctgctgtcaggcttcggtgcagctggaggatcggatgttcaatccgcttcctctttaccatacatattctctgggatgcgggattttggatatgatcgcgcacggtcagaatatctgcatcaacggaaatctgaaaacgctgttccgcgacatcaagctgtacaggccgagtattctcatggcggtgcccctgattttagaaaatctgctcaaagaaatccaccggatccaggaaaacatgggaatccgggagcagacagcccaggcagtagaaaaatataaaaaaggaatctttacaaaaaagcccgtgaaggtcaacggtatggatctgattctgggggaccagctgaagacaatctgctgcggcggagcgcatttgaatgaaaagatagcagaggaatttgcagcttatggtattgatgtacttcagggctatggaattacagagtgcagtccactgatcagcaacagcatcaggggacaaaacagaatcaactccgttggccttccgcttccaggggtggaattaaagctggcagacggagagattctggtgaagggtcctattgtatttaaagaatactataaaaatccgggcgctacagaggaaagttttacagatgaatggttccatacaggggacattggctatatggacagaaaaggttttctctatatctgtgggagaaagaaaaacctgatcgttttcaataacggaaaaaaggtggttccggaggaactggaagcttatatccaggagcttcctcttgttaaagaagtgatggtgtacggggcaagtacgggaaatgcactggatgaagtgaagctttccgcactggtctgcgtagacgcggagaagaccagtgagacagacaattataggatactggaaagtatacaggagtccattgcggagttgaacgcaaaactgccggtctataagagaatccagtctgtaaagctgtccgagtccgaatttaaaaagacttccatgcagaaaatccagagaaggaaggtgacggtatgacagaagaagaaatgctgctccttgtagaagagatcgtaagagaggtgacaggggtgaagaagctgaccatggatacagagtttgtaaatgacctggcgctgaattccatggatgtggccaatctggtatgcgcgttcgaggagagatttgatacggatattcccatgaaagatgtgcgcaaccttatgcaggtgagagacgtgattcggtatatgcagaaatgggaacatatgcgggacgcggacggccgcgccgatgagaacaatttgtaattagtaagaaatcacaggaaattatgaaaatctcttgacaaagaaaggcgaacttgatattattaaaaaacagaacgcactctgtttttgcatttctgaagttagacaggaaagtagggaggcatatgagaagacaggttttttcattgctggttgacaacaatccgggtgtactaagcaggattgctggacttttcagcagaaggggatacagcattgacagtattacggcgggaatgactgccgatcccagatttacaaggattacggtcgttgcaagcggagacgaactgatactgtcccagatagaaaagcaggtccgcaagctggaggatgtcattgagatcaaggttcttaaggacgatgaatccgtgtacagggagctgatcatggtgaaggtccgcgccagtgcagcacagcgctcggaagtgatttccatcgcagatatattcagggccaagatcgttgatgttgagaaggaatccatgatgatcgagctgacagggaaccagtccaagctggaagcgtttctgaacctgctcgacggctatgagatactggagctggcaaggacagggatcacgggtcttgcgcgtgggatcaaggatgtcacatttatagactgacaggcagtacatagggacgggaagctagaggcagacagcctttaactcatataaaaagcaatttatcatcagataaagcgcactgatgaaagagaaattaggaggaatgtcaagatggcagcaaaaatttattatcaggaagactgcaacctttccatgctggaaggaaaaacaatcgcaattatcggttacggaagccagggccatgcacatgcactgaatctgaaagaatcaggctgcaatgtgatcatcggtctctatgaaggaagtaagtcctgggcaaaagcggaagcacagggatttgaagtatttacagccgctgaggcagctaaaaaagcggatatcatcatgattctgatcaacgatgagaaacaggctgcaatgtataagaaagatatcgagccaaatctggaagagggcaatatgctgatgttcgcacatggttttgcaatccacttcggccagattgtacctcctccgtatgtagatgttactatgattgcaccgaaggggccgggacacacagtaagaagtgagtatcaggatggcaagggtgttccttgtctggtggctgtacagcaggatgcaacaggcaaggctttggataaagcgcttgcatatgcgctgggaatcggcggtgccagagccggcgtactggagaccacgttcagaacagagacggagacagacctgtttggcgagcaggcagtactctgcggcggtgtatgcgcattgatgcaggcaggcttcgagacactgaccgaggccggatatgatccgagaaatgcatacttcgagtgtattcatgagatgaagctgattgtagacctgatctatcagtcaggatttgcaggaatgagatactctatctccaatacggctgaattcggagattacataacaggaccaaagattatcacggaagataccaagaaagcaatgaagaagattctgagcgatatccaggacgggtctttcgcaaaggaatttctgcttgatatgtcagacgcaggcggccaggctcacttcagagcaatgagaaagcttgcagcagaacatccggcagagaagatcggtgaggaagtaagaaaactttacagctggagtgatgaagacaagttgatcaataactaatcactgagacagaaaagtaatcataggataaaggccccggcgtttcgaatgacgtgccgggggtttttttttcctgtaatttggcgaggagagatttttttgactgacaagaatgatttcagccagggcagtatcgcgcgtaatattatgggtctggcactgcccatgacgctggctcagctgatcaatgtgctgtacagcatagtggacaggatctacattggccatattccgcatacttcggcggaagcgctcacaggaatcggcctggcgctgccagtgatcacaattattatggcttttgccaatctgtttggaatgggcggggcaccgctgtgctcgattgcgcggggcggccatgaggaagagaaggccagaaaagtaatgggtaattctttttccatgctcctgctttcgggagtggttttaatggctgggtgcctgctgtttaaaaagcctttgttgtatctgtttggtgcaagtgaagttacatttccctatgcagatgcttatattaccatttatttgtgcggaactttgtttgtaatgatcagcctggggatgaacaatttcatcaatgcacaggggtttggtaagatcgggatgctgacagttactctgggggcggttacaaatattattctggatcctattttgatctttgtattccagatgggtgtccggggagccgccattgcaactgtgatatcccaggggctttctgccctttgggtaatgcgttttctgacggggaaaaagacaattttgaaactggaccgtgattccatgcgtctggataaaaaactggtaaaggagattacggcgctgggaacatcgggatttgtgatgtctgtgacgaacggggccgtacagatcgtatgcaatgccacgctgcatcgctatggtggggatctgtatgtgggaattatgacggtaatcaattccgtccgggagattattacaatgcccatcatgggacttacatccggagctcagccagtaatcggatacaattatggggcggagtgctatgacagagtaaaatcggcaattaagttcatgtcctggtgcgggattgtatttacttttctgatgtgggctgttctatttttcgagcctgcatttttcctggggctttttacaaaagaggaagaactgatcagagcaggtataccagccatgcggatctatttctgtggaatcttcatgatgtcactgcagttcgcagggcagtccacttatgtggctttgaaccgggcaaagcaggcggtcttcttttcgctgttcaggaaagtaatcatcgtaattcctctgaccctcctgctcccgctgatagggaatctgggaacagcgggtgtattttgggcggagcctgtttccaatgtcattggcggaacggccagttttgtgacaatgctgattaccgtgtggccttcattaaagaaacaggaaacgaagttgtagcagttttggcttgtccgaatggttatgtgttattttgttaccatgcacgacacataggtcgtacatagaaataatgttttcagaaaattacttgaaatacaatcattatactgcatattccgggccgatgtggtaaaataaaaacaacaataacacggatgttttctattttatcagaaaggagatggcagtatggatgaaagattatccaatcttcggtcaacgaagaatcccaaagcccgcattaaaataatgagcggccattttgcgacgagacattcccatgtgaatacctatattgatatgtccacggtaaagacccgtcacaacaatgcacgggagacggccaggacgctggcggcagaatacatgacgaatactttgatagacacgattgtctgcctcaagaataccgaagtgatcggcgcttttatggcggaggctttgtcggacagcgtgcatgcatccctgagcggcggcaataatatctctgtcgtaacgccggaatttgattcctcagggcagatcctgtttcgagataacaaccagagaatgattgaggcaaagcaggtgctgattctcacggattccctggcaaccggggcgcttgcctatcaggcgatagagtcggtgctttattatggcggcacggtctgcgggatttgtgcggtgtttagtgcgatctcaaaggtggcgggattggaagtaaagaccatctttaccagctctgatctgccggactatcatgtgtataggtcctatgaatgcccgatgtgcaaggccggtcaaaagttggaaggcataattaatagttttgggtattcgaagctttaaaggcggctggaagcctgtacgggcggagaacagcgatattgaatgaatccgaatgaaaatctttttgagagtgaaatattgacgcagaaaggagacgcccatgattgtatgggcgcctcctttatcaatccatgcgtatccccccggaggggagggatataggaaattcctctggaatttcctatatcacaaaaaacacccgcctgacgggagcggatgctttgctttttatctattatgcaatgtcgttaactgctttggttaagcgggaaatctttcttccaactgtgtttttgtgataaacacctttgcttccagccttagaaatctcagcgattgcagcctgtaatgctgtcttagcagccgctgcatctttctgtgccactgcagtctcaactttttttacggatgtctttactttagatttgattgatttgtttcttgcagcctttgtttcgttaactaaaattctttttttagcagatttaatgttagccaatctgtacacctccaaatatgtgaaattttcaaatagtgaattcatgattccgttaaaatcggacacggacgtttaaacggaacatactcatttattttatgctaaggaacaaaggttgtcaatacatatttctcaaaatattgcaaaaactacctgtaaattcaaatgatgttatggaaaagtgaggacttgaagatggtggaaaagtatagtattaggactgaccttgcgcttgaggagaaagaacggtttgaatcagacaacgtggaggttcagggggttgttcttgaggaggaatttgatgaagaacgtgaaatacgtatttcacgggtacgcattgagacagaaaagggcgccaaggtcatgggcaagccggtcggtacttaccttactgtggaggcgccgaatctgggtgtaccggatgaagggtatcacagggagatttcggaagaactttctggttacattaaggaattgatagagaagctgggactgcttgacaaagaagatttatctgttctgatcgtagggcttggaaaccgtcaggtgacgccggacgcgcttggaccatatgtcgtggagaacttatgtgtgacacggcatatcgtgaaagaatacggaaaatatgctatgggaatggaacatgccaatctggtcagcgccataataccgggtgtcatggggcagaccgggatggagacagtagagattgtcaaaggagtagtggaggaaaccagccccgatctggtaatagccatagacgcgttggcggccagaaacagcagaaggctaaaccgaaccgtgcagatcgcagatacgggtatccatccgggttccggggtgggcaaccaccgtaatggactgacgaaggaatcactaggagttcctgtaatcggtattggtgttccgacggttgttgatgcggcaaccatagtgaatgacacgatggagaatctgatcaacgcgctggagacctctgaaatgttaaagggcgtgggagatgtgctgcgcacttacagcgctgcggagaagtatgagctggtaaaagaattgatttcccctcatctgaacggaatgtttatgaccccgaaagacgtagatgaaatggtaaagcagatcagttataccatctcggaggggctgaacatattgtttaccaatgcagggcaggcataataagtaaacaaggctcatatatatgaaagtgtgtaagggggtcagacccctccgacggaggggtctgacccccttacacctgtcactggaatattacttttgaaagaaggcggtttatgaagcaatcggcattcatacgggtggcgcttactgtcatcggagggatagtatgtatctgcctgctctgcattagcggaaaaggtattatgaaggaatggagatatgacagccaggaggctgttttgaaatatacggaggaaatgtacatgccgggcctggcttatctgaaagaggacccgggacccacggccgttcagtggatcaagaaaaatgcgatgtcatggctcccgctgatacaatatgtggagcagaagcagccctatgattctgtgatggaggatgaggagacgatcgcaaagattctggaaaatcaggccaatgatgagaatatgatagatgaaaacgggaatctgatagggaacaaaacggcggcagctcaggaacctgccgtggagcagggacagtctccgatcgacatgtcgattgaaaggctgcgggattttgattatctgatcagcaatttttatatcgtggatagtaccacgatgatcgggccggagcagttgaatgtggatgacctgctcggcagaagcatgaagattgaccagagtaccggcggtccgaaagtcctgatattccatacccactctcaggaaacgtttgtggactccacgcctggagatacgaatacgagtattgtgggagtaggtgagtatctgacaaaactcttaaatgaaaaaggaattgagacgatccatgatactggtgtttatgatattatcaatggacagctcgacagaagcaatgcctatgaaaatgcggaggcatccatacgtccgattctggaggccaacccgtcggttgaggtggtcatagaccttcaccgggacggtgtggcggaagacacccatctggtcacagagataaacgggaaaccaacggctaagatcatgtattttaacggcttgagccgcaccaggacaaatggcgacatcgcctacctttataatccttatatacaggataatctggcgttttccctgcagatggagcttgcttccgagagcaattatccgggattcgccaggcatatctatctggggggctacagatacaaccttcatctggtgccgaaatcccttttggttgaagcgggagcacagacaaatacggtagaagaaatgatgaatgccatggaagttctggctgatacactacatcatgtactgacggaataacttttatttgaataaccctacattttgtgataatatgaaatgaatgtaaaaaggagagagacacatgggaaataaaaatacatatgatgcggatagtattgccgtattagagggacttgaagcggtcagaaaaagacccggtatgtatataggaagcgtttcaacaaaaggcctgaatcatctgatttatgagattgtagataacgctgtggatgaacatcttgccggttactgtacacagattcatgtcacactggaaaaggacggctcggccaccattgaggataatggccggggcgtccctgtcggtatgcacaaaaaaggggtgtctgcggagcggattgtatacaccacactgcatgcagggggcaagtttgacgattctgcctataagacaagcggcggcctccatggtgttgggtcttccgtagtaaatgcattgtccgcctatatggacgtgcaggtcagcagggagggccagatccatcatgacagatatgagagaggtattccggtgattgaactggaggatggcctgcttccagtgatcggtaaatcaagaaagaccggcaccaagattaatttcctgccggatgatacgatctttgaaaaaaccaggttccgggccgaggaggtaaagagccgcctgcacgagactgcttacctgaatccggaactgacgattatatttgacgataaaaggctggaatcaccggagcacatcgtctatcatgaaccggacggaatcctcggattcataaaagacctgaatcagaaaaaggaaaccctccatgagccgatttattataaaggagaatcagaaggaattgaggtcgaagtcgcactgcagtatgtgaacgaattccacgaaaatgttctgggattctgcaacaatatctataatgcagaaggcggaacgcatctcactggatttaagaccacgtttacaacggttatgaatcagtacgctcgggaattaggcattcttaaagagaaggatgccaactttacaggtgcagatatccgtaacgggatgactgccatcgtatccattaaacacccggatccgagatttgaaggccagaccaagacaaagctggacaaccccgatgctgccaaagctaccggtaaagtaaccggagacgagattgttctgtacttcgacagaaatctggaaaccttaaagtcggtactttcttgtgcagaaaaagcggctaagatccgcaaaacagaggaaaaggcaaagacaaatcttctgacaaagcagaaatactcctttgacagcaacggaaagctggcaaactgtgaaagcagggatgctaaaaaatgcgagatatttatcgtggagggagattccgccggaggatctgcaaagacggccagggacaggaattaccaggctatcctgccgatccggggcaagattctcaatgtggaaaaggcaagcatcgataaggtgctggcgaatgcggagataaaaacgatgatcaacgcatttggctgtgggttttccgaaggatacggcaacgattttgatatctccaaactgcgctacgataagatcatcatcatggccgatgccgacgtggacggcgcgcatatatccacgctgcttctgacgctgttctaccgttttatgccggaactgatctatgagggacatgtttatattgcaatgccgcccctctataaggtcatgccgaagaagggggaggaagagtatctgtacgacgataaggcgttggagaaatacagaaagacacatgacggcccatttaccctgcagagatacaaaggtctgggagagatggatgcgcagcagctttgggaaaccacactggatccggagacaaggctcctcaaactcgtcgagatcgaggatgcgcggatggcatccagtgtgacggagatgcttatgggcacggaggtgccgccgcgccgcatgtttatctacgaaaatgctgcggatgcagagcttgatatataggtaagaggagatagagaatgagcagtagtgaatcacagattatcagaaccgaatattccgaggttatgaaaaaatcgtatatcgattacgccatgagcgtgatcattgccagagccctgccggatgtgagggacggactgaagccggtgcagcgcaggaccctgtacgacatgtatgaacttggtatccgttatgacaaaccctacaggaagtgcgcccgaatcgtaggcgataccatgggtaagtaccacccccacggagacagttccatatacgaatcgcttgtggtcatggcgcaggatttcaaaaaaggaatgattcttgtagacggacacggtaacttcggttccatcgagggggatggggctgccgccatgcgttatacagaggccaggctggccaagtttacccaggaggcttatctgggggatctggacaagaatattatcgattttgggccaaactttgatgagaccgaaaaagagccgcttgtgcttccggtgcgtgtacccaacctcctgattaatggggcggagggaatcgcagtgggaatggcaaccagcattcccacccataatctctgcgaggtgctggacgccgtaaaggcatatatgaagaatgaccagatcagcacaaaacaactgatgaaatatatgaaaggccctgattttccgaccggaggcatcgttgtcaacaaagacgacctgctgaacatctatgagactgggcagggcaagatcaaagtccggggaaaagtagaggtagaggaacaaaaaggcggcaagaaactgctggtaataacagagatcccttataccatgatcggaagcggtatcggaaagttcctgaatgatgtctgtggtctggtggagtccaagaagaccagtgatattgtggacatttcaaaccagtcttctaaggaaggtatccggattgtactggagctgaaaaaaggggcggatgttgagaacctgaaaaacatgctctacaagaagacaaggctggaagatacctttggcgtaaacatgctggcggtagccaatgacagacctgagacgctgggactcaaagcaatcattgaacatcatgtggatttccagtttgagctgatgacaagaaagtacaccaccatgcttgccaaagagcaggaaaagagtgaagtgcaggaaggcctgatcaaagcctgcgatgtcatcgacctgatcatagagatcctgcgtggaagtaaatctgtaaaagatgcccgtgcctgcctggtaagcggtgtgaccgagaatatcaaattcaagtccagtatttccaaaaaaatggccgctcttctaaggtttactgagcgtcaggcgacagcaatcctggaaatgcgtctctacaagctgatcggcctggagatcgaggcccttcagaaagagcacgaagagaccttgaaaaatattacgctctatgaggatatactgaacaattacgactccatggcgaatctgattatggaagagctggattcttataagaaagaatatggcagaaaacgccgcaccgcaatcgagaacgcggaggaagcggttttcgaggaaaagaaaatagaagaacaggaagtggtattcctaatggaccgctttggatatgcaaagaccgtagatgtcactacttacgaacggaacaaagaggcggctgacagcgagaataagtacgtagtccactgcatgaacaccggtaaaatctgtattttcaccgatacgggcaaaatgcatcaggccaaggttctggacctgccctacggaaagttcagagacaaagggactccgattgataacctgacaaactattccagcagcgaagagcagatcgtcatggtctgtgatgctgaacaaatgcgttttgcaaaactgctgtttgccacaaaacagggtatgatcaaaaaggtagaaggaacggagttccaagtggcaaagcggaccatagcagccacaaagctgcaggatgaagatgcactgattcatgttagcgtagtaaccgaaaaccaaaatatcgtccttcagacaaaaggaggatatttcctgagattcccggcagatgatatcccggagaaaaagaagggtgcggttggcgttagaggaattaagctccagaaaaaagatgagctggagaacgtgtacttgtttgaagaaggaacggaacagaagattgtctatggtgaaaaagaagtgacactgaaccggctgagacaggctagaagagatactctggggacaaagagccgtaattagagcttgatttatacaaacattttatagtgactgccataaaattgaactacaaactgcttgtttgtaaatacggcacatattataattgtcttacgatcttgggatataatctggtaattgcgttgagatgtcaaaacgtagatggagtctaacggcgtaattacataaggtatgttggggtacaaggtatgtttatcaaacaatatggcgtatttaagggaaaaaatcacaacgaaaggatgttattttatggtagaaaaagaattattaaatgcaatatcggatatgatggatactaaatttgatgaatttaaaacgaatttagtgacaaaggacgacatagcgaatatggcgacgaaggacgacatagcgaatatggcgacaaaggacgacatagcgaatatggcgacgaaggacgatatagcgaatatggcgacgaaggacgacatagcgaatatggcgacaaaggacgacatagcgaatatggcgacgaaggacgacatagtaaatatggcgacaaaggacgatatagcctgtatatggaaagtaattgctaagctgcctaccaaagctgacttaagggaagttgagaacaacgttcttaccgaagtagacagagtacaggagattggtacaagacattacaatgaagtaaagaaggagatgagccagctgagagcagaagtcaggtcatatcaaatgggcagcttaaagcttagagttgatagattggaaagaatgctcgaactgtaggagctacttattttacgatgtaacagtaactgttcagaccatgccgtgcactccgctgcacggcatggagccaataggacaatgttatttcttgaaatcctccttgcatttaccaaaaaaaggtgttatactcaatgatagttacataaggaacccggcagaagagtgaacgaaagttcactcttctttgttgctaaggatgcagcatcgcagtttatacaaaaccgcttatgaccggaaagcttattataacagttttgttaccttgttgaacataggcagttcaataagtataaaaaacaatgcagagaaaggaagtttagtgtgtcgagaagagaacagtatgaacagcagaccgaggaacttatgataccgattgttacggagttcgggtttgaactggtggatgtagaatatgtaaaagaggccggaacgtggtatctgcgtgcttatattgataagccgggggggattaccgtggatgactgtgaggcagtcagcaggaagttctcagatattctggatgaaaaggattatattgaagatacttatatttttgaggtgagttccccagggctgggcaggccgcttaagaaagaaaaagattttaaacgcagtctgggtgaagaggtcgaaataaaaacataccgggccatcaacagacagaaagaattcgttggaatcttgaaggattacgacaaagacactgtgacgatagagtatgaggatgaaacgtcacaggtatttgataaaagtgaaattgcgcttatccgtttggctttggatttttaatttaggaggaaataataatgaatacagaattattggaagcattgaatattcttgaacaggaaaaaaacatcagtaaagatacaatgatggatgcaatcgagaattctcttatcagtgcgtgtaagaaccattttgggacggctgagaatatcaaggtgatcatggaccgtgaaacctgcgattatgcagtatatgccgaaaaagaagtggttgaggaagtatttgacccggcattggaaatcagcctggaggatgcagaacagattgattcggctctccagatcggagatatcgcgcagatcccgatcgaatcaaagtccttcgggagaatcgcaacccagaatgcaaagaacctcattcttcaaaagatcagggaagaagaacgtaaggttgtgtacgatcagtattttgagaaagaaaaagatattgtgactggaattgttcaacgttatgtgggaagaaatatcagcatcaacctaggaagagcagacgccatgctgacggagaatgaacaggtaaaaggcgaggtatttaagccgactgaaagaattaaactatacgtagtagaggtcaagaacacaccgaagggaccaaagatcctggtgtccagaacccatccggaactcgtgaagcgcctgtttgaggcggaagtggcagaggtaaaggatggcacggtggagatcaagagcattgcccgtgaagccggatcacgtacaaagatggctgtatggtctaacgatgaaaatgtagatcctgtaggagcatgtgtcgggatgaacggggcaagagtcaacgcggttgtcaacgagctgcgtggagagaagatcgatattatcaactggagcgataacccggctttattgattgaaaatgcactgagcccggccaaggtgatttctgttatggcggatccggatgaaaaagcggcaagcgtaatcgtacctgattaccagttgtcgctggcaatcggaaaagaaggccagaatgcaaggcttgcggcgcgcttgaccggatataaaatcgatattaagagtgaaacgcaggcaattgagtcaggagaacttcctgaagattatatggaacagatggcgatgatggaagaaggctacgatggcagttacgaggaagagtatccgcaggagtatgaagtagactatgaagagccgtttgtggaagatacagaagaaccgtctgttgaagactatggggaaatagaattcatcgagaccgaagatgaataataaccttatgagaggtggaataattgagcaataggaagataccgatgcgcaaatgcgttggctgcggcgagatgaagccgaagaaagagatgctgcgcgttctgcgcactacagaagaagaatttgtactggatgctaccggaaaaaagaatgggcgcggcgcctatctgtgctgctcaaaagattgttttttgaaagcagtgaagaacaaagggctggagcgttcttttaagcaggcaattcctgcggaagtatatgagcgcctggaaaaggagatgaatgagattgatacagagtaaagctttatctctggtcgggcttgctactaaggcaggaaagacagtgagcggtgagtttatgacggaaaaggaagtgaagtcggggaaagccgcgcttgtgattgtcgctgacgatgcgtcggacaacacgaaaaagaagtttcgtgatatgtgtgaattttataaggttccaatttatttttacgcagataaagataccttagggcatgcaatgggaaaagagttccgtgcatctctggcgatattggacgaaggatttgcaaaaggaattcgaaaacattttgaaacgaaagacaatacaattgcataagggaggtagttgaatatgacgaaaatgagagtacacgaactggccaaggagctgggaatggacaataaagaactgatggatatgctggaaaagaagaatgtagaggtgaagacccatatgagttcactggaagacaatgtagtaaatgacatcagaaaaaatgttaagaaaagcgcggatgcaggaagacccgtagaggcagataagcctgccgaagcggcaaaaccggcggaagaagcgcccaaaaagaagaatatcgtgcaggtgttccgtccgcaaaattctaagagcgggagccgcatgcagcagggagggcgccagggccagcgcccgcagggcggtcattcaggccagcgtccggcgggttcagcccctggccagcgcccggcagcgtcaggccagcgcccggcaggttccgcacccgtacagcgccccgcaggaaatacaccaggtcagcgcccggcaccgtcacagcgtccggcaggaaatacaccaggccagcgcccggcaggcacggcaccggcacagcgtccggcaggaaatgtaccaggccagcgcccggcaggcacagcaccggcacagcgtccggcaggaaatgtatcaggccagcgtccaacaggctccgcaccgtcacagcgcccggcaggaaattcacagggacagcgtccgcaaggaggacagcgtccggcttatcagggaggacagcgtcagccatatcagggcaaccagagaaattctggttctatgtcttcacaggagacaagacaaaatggcggcaattcctctgaccagagaaattccggttaccaaaatcagagatacaacaacaaccgcggccagcggccggctggtggacagggcggaaacttcggcagaaaccagaacggagaaagaagctataataaccagggcggagacagaaattatggcggccagggcggcagaaatgtgggcggcggccagcgcactggcaacgtcccgtccagaggtacggaacgccgtgacagcagaagggacgacagagatgctattccaacaccattagtagaacaacagaaggtgcagaggaataaagcaaaagataaagagaaagactataagaaaaaagaatataaagacggtgactttgacagcaagaacaaaaagggcaaacgccagaaacctgctgtggaggttgtaaaaccgcagccgaaaccagttgagaagaaagaagagatcaaacaaattgtgcttccggaggttctgacaatcaaggaactcgctgataagatgaaaatcgtacctgccgtaattattaaaaaacttttccttcagggtaaagttgttacggtgaatcaggaagtagactatgacacagcagaagaaatcgcaatggaatttgacgttctctgcgaaaaagaggtcgtgatcgatgtaattgaagaacttctcaaagaagaggaagaagacgaaggcgctatggtaaaacgtcctccggtagtatgtgttatgggtcatgttgaccatggtaagacatcgcttctggatgcaatccgccatacaaatgtcattggccgagaggcgggcggaatcacacagcacattggtgcttatgtagtagaggcaaacggtgaaaaaatcacattcctggatacaccgggacacgaggcatttacagccatgcgtatgaggggggctaactccacagatatagccattttggtggtagctgccgacgacggcgtaatgccgcagaccgtagaggcaattaaccatgccaaagcagcaggcattgagattatcgttgctatcaataagatcgataagccaagcgcaaatattgacagggtaaaacaagaactggcagaatatgagctcattccggaagactggggcggcagcaccatcttcgtgcctgtatctgcacatacaaaagagggaattacagatctgctggagatgattcttctgacagcagaggtgatggaactgaaggcgaatccggaccgctttgcaagaggtcttatcatcgaagcagagttggataaagggaaaggatccgttgcaactgtacttgtacagaaggggacgctccatgtgggagacgctatcgcagcgggttctgcacacggtaaagtcagggcgatgatggatgataagggccgcagagtcaaagaagccggaccgtcccagccggttgagatactcggcctgaacgacgtgccgaatgcgggcgaagtatttgtgggatgcgagaccgaaaaagaggcaagaaattttgcagatacatttatttcccagaacagagtgaagctgctggatgatacaaaggcgaaaatgtcactggatgatctgtttacgcagattaaggaaggaaacctgaaagaattgaatatcgttgtaaaagcagacgtacagggttctgtagaggcattgaaacaaagcctgctgaagctttccaatgatgaggtggtaatcaaaattatccatggtggagtaggcgccatcaatgagtcagatgtaatcctggcttccgcatccaatgcaattatcattggattcaatgtaaggccggatgctaccgcaaaagagattgcagaccgggagggcgtagacttgagactgtacagagtcatctacaatgcaatcgaggacgtagaggctgccatgaagggcatgctggatccgatctttgaggagaaagtgctgggccacgcagaagtgcgtcagacattcaaggcttccggagtcggaacaattgctggttcctacgtgctggacggaacatttgagagaaactgttccgtacgccttacacgcgatggaatcgtaatctttgacggaccactggcatctctgaagcgttttaaagatgatgtgaaggaagtaaggacaggatacgagtgtggcttcgtattcgagaactttaatgatattaaagaaggcgatcttgtagaggcatacaagatggtggaaattgaaagaaaataaaaccgtttcgtttacggcggctatgtgaaggagcaattatgagaaaaaacagcattaaaaatacacggattaatacagaggttcagcgtgaactgagcaacatactgcggggaggcatcaaggatccgcgtgtggcaccgatgacttccgttgtagcagtagaagtggctcctgacctgaagacctgtaaagcatatatcagtgtgctgggagacaagaaggcacaggaggatacaatcaaggggctccaaagcgccgaggggtatatcaggcgcgaactggcccggactattaatatgagaaacacgccggaaatccggtttatcatggatcagtctattgagtacggcgtgaatatgagtaaaaagattgatgagctgaccagagatttgaaagacgaggctgaataatatgagtgtagattattccacagttaaaagcggatccgcctgcaatgctgactccgtagacagctctttgggagttgggttatctgagatactgaagggaaaacagtctatagcgctgggcgggcatatccgtccggacggggactgtgtgggctccagtatggggctctatctgtatcttacggaacagtatcctcaaatagaaacggacatatatctggaagagattcctgaggcctaccgcttgattcagaagacggatgaggcaagaaactgtattccggagggaaagcaatatgatctgtttatatgcctggactgcggcgatgagaaacgtcttggtttttcagcgcccttgtttcagaatgcaaaacagacattctgtatcgaccaccacgttagcaatgatgcatttgcggatattaactatatagtaccggatgccagttccacgtcagagctggtatttggacttcttgataaagaaaaaatcggcaaacctgaggcggaggctctctacatgggaatcgcgcatgataccggcgtgtttcagtattcctgcacctcaccggagacgatggaggcagcggcagatttgctgcgcaagggaattgacgggaacgatattatagagaaaactttttatgaaaagacctatattcagaatcagattctgggcagagctcttttggagagtattctgattttggataaaaggtgtatagtaagtgccgtgagtaagaaagaaatggaattttacggtgcgaagccgagcgatttggaagggattgtcagccagatgaagctgacgcagggaaccgagacggcgcttttcatgtatgaactggaaacgcagaattataaagtaagcctgcgttcgaaaggtaaggtggatgtaagcataatcgcccagtattttggaggaggcggccacgcaagagcggcgggattcacgatgaaaggctcattccatgatgtgatcaataatgtcagcatccagattgcgcgccagctggatcaggaagagacacaggtataacggtttatggtaaacggtattattaacgtatataaagaaaagggttatacatcccatgatgtagttgcaaaactcagaggaatcgtgggacagaaaaagatagggcacaccggcactctggatccggatgccgaaggagttctcccggtatgtctgggcagagcgacaaaactttgtgatatgctgacagataagaataagacctatgaggcagtactgttgtttgggaagatgacagatacacaggatattacagggaaaatactggaagaacgggatacatcattactgacagatgaatttgcaaaagagtgtatacaaaagtacatcggggaatatgaacagcttccgccgatgtattctgcgctgaaagtaaacggaaaaaagctgtatgagcttgcacgggaaggcatcgaagtagaacggaaaacaagaagggttcatattttcgatataaagataaacaaaattgatcttccaagagtacatatggaaattcattgttcaaagggcacctacattcgtacactttgccacgacataggcagagaagcagggacgggtgcctgtatggaagcccttagaaggacaaaggtaagctgttttgagatcaaagacagcctaaagctctctcagattgaggaatataaaaaaatggggaagcttacggacattgtaacgcctatagatgccatgttccgggaactacctgaattagtggtggcaaaggagtatgaagcactggcctataacggaaatccgctgcgccgggaatttatgacaaaagagaatgtttttatggacggacaatctgtaaggatgtacgaccgaaacaaacagtttataggtgtttaccgttactttactgaaagacaggaataccggcttgagaagatgtttttcatatcggattaataagcaggcatatccatgcaagtgataaaggaaaaattacggggaaagacatgcggtactatacagatattaattcttatcaggaaactgaaaaaacagccgttactctgggcaaattcgacagccttcacagaggccatcagaaactgatcagcagagtaagggattgcgcggagaaagaaaaattaaaaagcgttgtatttgcatttgacatgaagaaagaaacactgcttacaaacaaggagcgcagacagcacctggaagagcaggtagattgtatgatacagtgtccctttacgaaggaaatcagggagatggaagcggagacattcattgagaaaatattggtggatacgctacacgcctcccatattgtcgtaggtacagatttttactttggacatggcaagcggggggatgccggtatgcttgcggagctggccccaaattacggctaccggctggatgttgtggagaaagagttgtatggggacagagaaatcagcagcacctatgtaagggaagcgctggaagaaggcgatgccaggcttgcaaaccagctgctgggatacccttatcacatgacggggattgtggaacatgggaggcagctggggcgtacactgggatttcccacgatgaacattgcgcccacagaacgaaaaattatgcccagattcggagtatatacctgcagaatcctggtggacggcaagtggtatcacggtattggaaatgtggggatcaagccgacagtggcagatgagccaaggcttctggcggaggtatttgtttttggctacaaaggtgatgcctacggcaaagagattatggtggaattctgttctttcgtgcgaccggaaacaaagttttgttctgtggaagaactgaaacagcaggtggaccgggatatccaatccggaaaggcatattttcgggagaaaagcttgacaaactagagaaagagttaggggaagtacaaatgagtgtaacgacaatatttctgctgctgggaggactgggattattcctgttcggcatgaagatgatgagcgacggcctggaacaggttgccggcgcacggatgaggtcgattctggagttcttcacacaaaacagatttgtggggatgctggtcggtatcttgttcacggcagttgtgcagtcgtccagcgcgacgacagtaatggttgtaagctttgtgaattccgggcttatgaacctttatcaggctgccggggtaatacttggcgccaatatcggtacaacaatcaccggacagttgattgcatttaatctatcagatgttgcacctctgttcgtgatcaccggcgttgtaatgttcatgttcagcaaaaaacagaataccaagaaaatcggcggagtgatccttggatttggtatcctgtttatgggcttgagtacaatgggagatgccatgtcttccctgcgtgaatctccgcatatcgtagcgctgctcaaatcattaagcaatccctttgcggcgatcctggttggatttgcgataacagcaattttgcagagctcttcggccaccgtaggtatcgtaatcctgctggcttcccagggatttctacagtttacgatctgcttttatcttattctgggatgcaacatgggttcctgtgtctctgcgcttcttgccagcctggggggcaaaaaagatgcgaaaagggcggcctggatccatttcctatttaatatcatcggatctgtcgcaattttcattgtgctattgtttgcgctgcagccaattgcggatgcaattatgaaggtatccgggggcaatatgggcagggcagtagcaaatgctcataccttaattaaaatatgtgaggtgattttactcttcccgtttatgaaatgggtagtcagggtaacctatttaattataccggggaaagatgcttcgccggatgatgagtacgaactgaagtatatcgggaacagtacgatgattacacctaccacagcggttatatcaggcatctatgagctggaacatatgggctgcctggcgattgagaacctaaaaagaggtatggatgcgctctgtacactgaatgaggaaaagatcgccgaggtataccggcaggaggcgtatattgattatctgaacagggagattaccgactacttggtcaggatcaacagcatggagatccctaccgcagatgcgatgctggtaggcggtctgttccacgttgtaaacgatatcgaaaggatcggggaccatgcggagaattttgcggattctgcaaagatgaggatcgacagacatgtcacattcagtgaaaaaggaatccggcagctccaggatatgatggatctggtggaaaaaacactggtatactccttagagatgttttccaaccgcagccaggaacacatgcaggaagtcatggcgctggaggacgaggtggatgaaagagagaagaagctacagaaagcacatatcaaacgtctgacaaagggcaagtgttcaccagaggcaggcatgattttctctgatactatatccgggctggaacgtgtggcagatcatgccaccaatattgcatttgctatattggagccgcagaacaatgacgagtctgaagatgaagaagaatagtaaggaagaacggaaagaatacagcagaagaatacaatagcgtaaagtattgctttacataggatttaagttatgctatactattaaagtatgaattcagccggtgttcggtaataggaagactccaaccgttacttaatgccaggcggttttataaaagaaaataaaggaggaaacgtaagatgatcgcaaaggaaaagaaacaggcaatcattgcagagtatggcagaagtgaaggggacacaggatctccggaagtacagatcgcaattcttacagcaagaatcaacgaactgacagatcacttcaaagcaaacccgaaggatcaccactcaagaagaggacttcttaagatggtaggacagagacgtggtctgctggcatacttgaaaaagtcagatatcgagagataccgtactttgatcgaaagacttggattaagaaaataatctcaaatccacaaggatcttcccgggaggggggatccttttttgtgtttggaggagaggcgccgagaggcctgcggcttacagccccctcggctagactcatccggccagaacgaaaaaaaccgacccgatgccattaagacgggggcagcgtatagaattggtttcccggtatttaattggcaagagtagtgaatttggcggtgtttaagttattttccttcatggtgaagtggcaaaactaaatttgtgcggctttgtgtattccaacacacagacttctaacataaatatagcacaaaaaagccaatacaaatccgctgccccacattatgaagcctaccaaggaatgacgccttatcttccgcccggatgcaacagctgaagtcaaggaacgtccggctcctggcggggaaatgtctgctggtgaaatgtcctgacgctgcgcgaagaagctgtaggacatttcaccagcagacatttccccgccaggagccggacgttccttgacttcagcgtccccctacgcgccaaaacgcgcaccaaaaccaaagttcattccccaacttcattcttgatttaagagggcgactatgctataatatttaagattgtggtcaggaaagcaaaacccgagaccactgaaaaggatattagcggattctaatgtgtttttcagtagtttcggagtctcctgccacgaattatgtgaatagaaaaaaaggagaatgatatgtttaaaaagtttgaaatggaacttgccggcagaactctgcgtgtagacatcggaagagtcgcaaagcaggcgaacggagctgctctaatgcattatggggatacaacagtgctttgtactgcaactgcatccgagaagccgagagaagggatcgatttcttcccattgagtgtagaatacaacgaaagattatattctgtagggaagattccgggaggattcaataagagagaaggaaaggcttcagaaaatgccgtactgacatgccgtgtcatcgacagaccgatgagacctctgttcccgaaggattatagaaatgatgtgactctggaaaatctggttatgtctgttgaccaggactgcagtccggaactgacagctatgttgggtgcagctattgccaccagcatttctgatatcccgtttgacggcccgatctctacaactcaggtaggtctggtagacggcgagtttgtatttaacccgacagcagaacaaaaagatatctcggatctggcgctgaccgtggcttctacaaaggaaaaggtgattatgatcgaggctggtgccaatgaagtgccggaggatcagatgatagatgctatttttgcagcgcatgagttgaaccagaaggtgatcgcatttatcgagacgatcgtcgcagagtgcggcaagccgaagcactcctatgagagctgtgcagtaccggaagagttgtttgcagcaatcaaagagattgttactccggcagagatggaagaagccgtatttactgacgacaaacagacaagagaagagaatatacgtgtaatcactgccaagctggaagaggcatttgccgggaacgaggaatggctggatgtgcttggtgaagcagtataccagtatcagaaaaagacggtaaggaagatgatcctgaaagaccagaagcgcccggacggacgtgcaatcgaccagatccgccatctggctgctgagaccgatctgattccgagagttcacggctcagctatgtttacccgtggacagacacaaatctgtaccgtgacaacgctggcgccgctgtctgatgcacagagaattgacggactcgatgaggcagagacctccaagagatatatgcaccactataatttcccgtcctattctgtaggagagacgaaaccatccagaggaccgggccggcgcgaaattggccatggcgcgcttgcagagagagcgctgatccctgtactcccaagtgagtcagagttcccatatgcaatccgtacggtatccgagacatttgagtccaacggttctacttcacaggcaagtatctgtgcctcaagtatgtcgctgatggctgccggcgttccgatcaaagcagcagtagccggtatctccgctggtcttgtgacaggagatactgacgacgattatctggtgctgacagatatccagggtctggaagatttcttcggcgacatggacttcaaggttgccggaacccacaaaggaatcactgcaatccaaatggatatcaagattcacggactcacaagaccaatcatcgaggaagcaatcgccgcaacaaagaaggcgagaacctatattctggatgaggtcatgaacaagacaattgcagagccaaggccggaggtaggcccatacgctcctaagatcgtacagatgcagatcgatccgcagaagatcggcgatgtagtcggccagcgcggaaagacaatcaatgcgatcattgagcagacaggtgtaaaaatagacattactgatgacggtgccgtctccgtctgcggaacagacaaagcaggcatggatgaggcaatgaagatgattgcaaccatcaccacagatttcgaggccggccaggtatttgaaggaaaagtcatcagtatcaaagaatttggtgcatttctcgaatttgcgccgggaaaagaaggaatggtacacatttccaagatttccaaagaaagaattaacaaagtagaagacgtactcaaactgggcgatgtagtaaaagtagtctgcttaggaaaagacaaaatgggcagatttagtttcagtatgagagatgtagcggagtagttcgctggtatggggccgccttcccggatacacctgacagtttccgggggctggccgtttgcggggaagtactaacggtaaaaaagcagaagcgtatagcccggcggcattcactgagaaatcttgatgatttctcagctcaggccgccttgaggattgattcggaatcaatcctcagctatacgcttctgcttttttaccgtaagtacttccagccgcgcacttagaagcccccggaaactgtcaggtgtatccggcaaggctgctcgcatcaaggcgttaactgttccgctacatggaagctctctggcgggagaggcggatgtggcttggctgaggcggacatttgcatcagtgttaggcaatttaggtgggataggaaattataaaaggcatttaaaaaagcgcttcttcaagccagacaacctccccagccattcccgttcagaaacccatcttatttgagtacacaagcagatgcaggcacacatggggcggaaaggcttctggatgcgggttagggggagtaaagggaaaaaacagaaaaaccgggacaacctgcacacatcacgtgaaatcctgatggatttcgcgcgctgggtgcaggaaaatgagtgattcggaatcacgcattttgtcccggtttttctgttttttccctttactccccctaacccgcatccagaagcctttccgccccatgtgtgcctgcatctgcgtcccgcccccactcaactccagattttcaagtcataaatttgagatggggacatatattgtttaaagaggtggacaagatgaatacagttaacagaaaacagcaggtcctgcaggtgcttgcgaaaccggtccggtctgccgtggaggcggaagggctggattttgaaaaggtacaggagatccggttgcggattggtaagcctcttattctggtttatgacaacgaggaaaggctgcttcctacgggggtgtctacgaggtacctgatcactaaggaggagatacgtgagacgctggaatatatcagccactattcactgtatgcatatgaacacgagatgagacagggatttattacaatagaaggagggcatcgcgtgggggtgatgggaaaggctatactggaaggcaataaagtgaagaatctgcagtatatttcttctgtaaacataagaatgtcccatgagattctggggtgtgcggacaaggtcatgccctatattacaaagaaccgccaggtatgccatactctggtgatttcaccgccctgttgtgggaaaacgacgctgatacgggatctgatccggcagatatcagacggaaacaggtacgtaaagggatgtacggtgggtgttgtggatgaacgttcagagatcgggggctgctatctgggagtcgcccagaaccagctgggtatgcgcacggatgtgctggactgctgtccgaaagcggaagggatgattatgctgatccgctccatggccccccaggtgatagcggtagatgagatcggttctccggaggatgtacatgctattgagtatgccatgcagtgcggatgtaaaatgattgccagcgtacacggcctgtcaatggctgaggcagcggataagcctgtgcttggcaggctgatcagagaacgcaggtttgagcgctatatcatactcggcaatgagaaaaggcccggggaggtgcgggaagtatatgacgaacgggggagcctgctatgcagagatttataggatgcctgctgattttaggggcaacgacaggggcggggatcgcctatggaacagagctccagcggtatctggaaaaactcctctatatccggcatatcgtttatatgctcaaaggagaactggagtactccaatgcaccgctgggggaaatattcggaagagttgcggtaagggtaaaggagccttaccgtaaatggctgcgtgtgatggagcggcaggtagaagagcgcgaggaggatgagtttgcaaaaatatggaaccggtctgtagaccgtaacctgagtgaacttcatctcaagagcgttcattctatacagctgaaagagctgggaacatttctgggacagctggacggggatacatccagcaggacaatgcagctttacctgaacaggctggagctggaaatcgaaaaagtaagagaagggatggcagcaaagaaaaggatcgggaactgtcttggcgtgatgggaggaatttttctggttgtcatactaatataactcacgggaggattccatgaccataaatctgatatttaaaattgcggctgtcggaatactggtttctattctgagccaggtgctcaagcacagcgggcgggatgaacaggcatttcttacaagctttgcgggactgatactggtactgtcatgggtactgccatacatatacgatttgtttacatccattaaacaattgttttctctgtagctgcggcagtgtataggaatacgaaaggggagcttatatgtgagcatgattcagatcggaattatcggcgtaataggcgcactgctgtcgattcagtttaaaagcggcaaatcagaatatggaatttatatgagcgtggccatcagtatccttattttcgcctgtattgtagacaggcttgaactatttgtaaggacggtggaacaggtcaatcagtatatcaagatagataccagctatatcgcaactatgctgaaaatgatcggtatcacctatatagccgaattttcctcaagtgtctgtaaggatgccggatatcagaccattgcggttcagatcgagatcttcagcaaactgaccatactggctctcggaatgccggtattactcgccctgctggagacaatccgggagtttctggcatgaaaagggggcaaaggatatggctgggggccttggcgtttttgatatcagtacttctttttggcctggcaggggacaagataggctgtatgacggtatacgcagcggaggatacggtagattatgatgccgtggaaagcggcgccgagagcaaattgttctcggagtttgatttttcagagattgacaacagcctgcaaaaaatatttccggaagaaaaaatggattttaagagcctggttaccgctctaattgaaggagacggaaaaaatgccggggaactgattatggatttcatatcggaccaatttgcctatgaattcaggtataaccgccagaatctggcatatatgctgctgattgccgtgattgccgcaatttttactaatttttcaaatgcgtttcaaaacaggcaggtgtcggaaatcagcttttacgtattatacatactgctgattaccatgtgcctgaatgccttcaggatcgccatgagcggcattgaagggcatctggagacgcttctggattttatgcgggtgctgtgccccagttattttctggcagtcgccatcgcctcgggaagcagcagctcgctgattttttataatattgtgttatttctaatctatgtggtggaggtgttgattttaagattcctgctccccgtcataaatatctatattatggtgcaggtgctgaactacctggcaggggaggagtatctttctcagtttgcggagctgctgagcaagatggtgacctggatcttaaaaacactggtaacctgcgtaattggaatcaatgtaatccagggaatgcttgctccggccattgacgctttgaagcgcagcgcgctgacaaaaactgccgaggccatacccggaatcggcaacgcaatcggaggtgtaacggatgtcgtgttgggaacggcagtgctgatcaaaaacgggattggaatggcgggagccgcggttatgatcgctatctgtgcgataccgattgtacagatggcgcttatgaccctgatgtacaaactaaccgccgcactggttcagccggtgtcagataaacggattaccggatgtatcagcagtgtcagccagggatatgaacttctgatgaaggttgtattttctacggggcttttgtttcttttgaccatcgcagtcgttacggctagtacatcgtaaaattagcagctgatgaatgattagacgatttgctggtacattgtaaaataaggaactgccgcttaagccgggtaaaggagagaggatgtttgactttatatatgagtggatacagaaccttgctttctatctggtgatcgttaccgccgtactgcagatcataccgggaaaagggtataagaaatatgtgcagtttttttccggaatggtgatgatcctgctgatgctgacacctatattgaagctgacgggaatagaaaaccggttttatgatctgtatcacagccaggaatacgaaatggaaaaggaagaaattgaaaaacagaaagattattttgaaggcttggatattctggattttcttccggaagaatacgggcaggaggaacaaaatgcggagaataccaaaaagggaatagaagtggaggagatacaggttggagaataaatggaaaaatatcctgggtaaaataaagggtaagaaaatgcttccacagaaaaaccagctgctgatccttcttctgatcgggattcttctggtagtgatcgcaattcctacttccaataaaaagaaaggaagcgcatcggatgagagtagggacagcggggagggtaaggcagcctcttatgtaaatacagatgaggaatacgagcagtaccttgaaaagcgggttgcaagagcgctggaatacgttcagggggtggggaaggcagaagtgatgatcacactgaaatcttccggtcagaagatcgtggagaaggatcagcagagcagcagccagaattcggaggaggaagacagttccgggggtacaaggagcgtggaagagaggacaacggataagacgagtatttatgagcagggatcggacggttcccagtcaccctatgtgagcaaggaactgactccggaaatagccggagtgctcgtagtagcggaggggggagacaatgcggttgtagtgcagaatataactgaggcaatccaggcattattcggtgtagaggcgcataaaataaaaataatgaaaaggactgatacataaaaggaggattccaagtgaagcgtttatttaagaaaaatcagatcatcattaccacactggcagttatgattgccatcgccggatacctgaattactcaggacggctgtttggacagtcagacaaaggtacgacagaggcaaatgcagaactggcaaacaaggagctgctggatatttcggaggaagacctggaaacaggctccggcgacattgcaagcaatgattccgaaatagaagggacgcccggagaggccgtgctgacaaacagcggagcagacaccacggttgcacaggcaaaagtagccagggaacaggtgcgcgctcagaataaagaaacgctgcaggcaatcattgacaacaccaacatcagcgacgaagagaaacaggatgcagtggcacagatggtaaagatgacggaactgtctgagcaggaggtggctgtggaaacactgatggcttccaaaggattttcagaggcagttgtaagccttacggcagattccgcggatatcgtggtggacagcgcagagctgacagatgcaaaccgtgcccagatagaagatatcgttacgagaaagaccgatattgcacctgaaaatattgtaattacgccgatccatgagggcggaacagcagaaggagagtaagtgtaccatgcgcagatacatatgctgcctgttgcgtataataatttttgaaacaggcagtataaatctggaaatgtgggaagaatatttccagtaaacaattgcaggtgataccttattatggtaaacttatttaatgtgcttaattgtaacaaatacatccgaaaaagatcagcttacataaaagagacgaaaacaggagattacagatatgtcagagattacaaatgaaataaaaaagagaaggaccttcgcgattatttcccaccctgatgcgggtaagacgacactgactgagaagttcctgctgtacggcggggcgattaaccaggctggttccgtcaaggggaaagcaacggcgaagcatgcggtgtcagactggatggagattgagaaggagagaggtatctcggttacttcttcagtccttcagtttaattacgggggatactgcatcaatatcctggatactccgggacatcaggacttctctgaagatacctaccggacattgatggccgcggactctgcggtgatggtgattgatgcttccaagggtgtggaggcccagacgcggaagcttttcaaggtctgcgttatgaggcatatcccgatttttacattcatcaataagatggacagagaagcaaaggatacatttgacctgctggatgatattgagaaggaactggggattgcaacgtgccccgtgaactggccgattggttcgggaaaagcatttaaaggtgtatatgacagacagaagcaggaagtggaattattttctgatacacataagggaacaaccgtgggggaagtcaaaaagattgaagcaaacaatccggaactggactggatactcgggacagaggcgaaggttacgctggaggaggagatcgagctcctggacggcgctgcagcggaatttgaccaggagctggtcagcaaaggcgaactttcaccggttttcttcggctctgccctgactaattttggagtagagacatttctgaagcatttcttaaggatgaccagttctccgctgccgagaatgtctgaccatggggagatcgacccgatgaaggaggaagaattttcagcttttgtattcaagatacaggcaaatatgaataaggcacacagggaccggatcgcctttatgcggatctgctccggtgaattcgaggcaggcatgtctgtctgccatatccagggggggaaggatgtgcgcctgtcccagccgcagcagatgatggccagcgagaggaagatgatcgagaaagcctatggcggagatatcataggcgtatttgatccgggcatattttccataggcgatacgctgacaacctccaaagaaaagttcgcttatgagggcatccccacgttcgcacccgaacattttgccagagtacgccaggtggatacgatgaaacggaagcagtttgtaaaagggatcaaccagatagcccaggaaggcgccatccagattttccaggaatttaacacagggatggaagagattatcgtgggtgtagtcggtgttcttcagtttgatgtcctgaaataccgtctggagaacgaatataatgtggagatcaggctggaaaacctgccctacgaacacatccggtggattgaaaatgaagaggtggatatggacaggctggtaggcacctccgatatgaagaagattaaagatttaaaggacaggccgcttctgctttttgtgcacgagtggagtatccgcatgactctggacagaaacaaagacctgaagctctctgaatttgggcgttcctgatatttccctttgcaaacagggggatatttgttataatgttttaagagattaaaccaacaggaggtttttacgatggcaaaggacgaaagaaatacttatacaatacagaacgattccagcatgggagaagtcaagattgcagatgaagtggtcgctattattgcggcgcttgcggctacagaggtggaaggcgtggcgtccatggcgggtaatatcaccaacgagctggtcagcaagctgggaatgaagaatctttccaagggtgtaaaggtggacgtgctggaaggcgtagttacggtttctctggcattgaacctgaaatataactacagcattatggagatttccaccaaggtgcaggaaaaggttaagaatgcggttgagaacatgaccggcctggaagtggccgatgtgaacatcaaggttgcaggcgtggaaatggaaaaccaggaataaccttttcgttgcaaagaatagcagatgtgtagtataataaaggatgtcgcaaggcatccttttcttaatgagaaaacatagagtctgggaatgccaatggaaaggagccaacatggtaagaagagaacttagggagcatatctttaagatgctgtttcagatagaatttaatgaaatggaagatatgccggaacatctgacattatactttgaaaacctgccgagtgctgcagaggaagataaagaatacataaaggataagtttgaagcaattgtaaaaaaagtaccggagattgatatagaattgaatgagaagactacggggtggaagactacaagaatgagcaaggtagatctgacgatcctgcgtcttgcggtctatgagatgaaatgggacgcggatgttcccgaaggcgttgcgatcaacgaggccgtcgagctggcgaagagattcagcggggaagagggcccttcttttgtaaacggagtacttgcaaaactgacagaccaggaggctggacatgcgtaatgtctacacggtaaagcaggtaaatgcgtatatcaaaaatatgtttacccaggacttcatgctgaacagaatctacgtgaagggtgaggtatccaattgtaaatatcatacttcagggcatatatatttttctttgaaagatgagtccggcacgatggcctgtgttatgtttgcaggctcacggtcagggctttcttttcgtatgcgggaaggccagcaggtgatcgtgctggggtccgtcagtgtgtatgaaagagacggcaagtaccagctctatgcaagagagattattctggacggggcgggacttctctatgaaaagtttgaggcattgaagagagatctgcaggagatgggcatgtttgcccaggagtacaagcagcccatcccagcctatgtgaagacagttgggattgtgacggctccaacaggggcggcggttcgggatattatccatatagcatcccgcaggaatccttatgtgcagctgatcctttatcctgcgcaggtgcagggggaaggcgcggcggagagtattatccgcggtatagagatgctggagaagaagggtgttgacgtcatgattgtgggacgcgggggcgggtccatagaggatctgtgggcgttcaatgaagaggaagtggcccgggctgtatttaactgccgcgtgcctgtgatttcggcggtgggacatgagacggatacgacaattatagactatgtgtcagatctgcgtgcaccgacgccgtctgcagcggcggaacttgccgtttatgagtacctgggtacggctggcgccatgagggagtatgaggcaaggctcagaagatccataatgcagagaataacccaggaacgcgtgaagagcaggcaggcggctatgaagctgaagcttgcgcatccccgccagaggctgctggaaaagcgtaagagagccgcggatctggagcaaaggctccgtcttttaatggagacctgcctggagaatagacgacatcggtttgcgatctatgtggagcagatgaaaggcctgtctccgctggccaaactgaatcagggatattcctatgtggagggcgaggcgggcgccaatatcaaatcggtccgccaggtgaagcccggtgacaaaatcaaagtttatatgacggacggaagtgtgcaggcggaagtccgggaaatcgaggaggaaccagatggcagaaaagaagattaaaaaagaagaaaaacagccttctctggaagagctttttgaaggcctggacgaagtggttgccagactggaaggagaggagattaccctggaagagtctttccagctttaccagaaggggatgaacatgctcaagcagtgtaatgagacgatagataccgtagagaaaaaagtacagattttggatgagaatggagatgcccatgaattttagagaatcttatcaggctaaggtagaagcaatcgaagcgatacttatcgcgtatcttcccgagcggacgggctatcaggcagtcatcatggaggcaatggaatacgcccttatgggcggcggcaaacgtctccgtccgatgttgatgcaggagatataccacctgttcggagggaacggcagaatcattgagccatttatggcggctattgagatgattcatacttattcgctggtacacgatgatctgcctgctatggataatgatgattaccgccgtggcagaaagacgacgcatgtggtttatggagaagacatgggaatcctggttggggatgccctgctgaactgcgcgtttgagactgcggccagggcttttgacgtagaaccgcaggagagcctgaggattgggaaggcgttgcagatcttggcgggaaaggccgggatatatgggatgatcggcggtcaggtggtagatgtgacatccacaggaaagatgatttcgggtgaaaaactggactttatctatcagctgaaaacaggtgcgctgatcgaagcttccatggccataggggcagtactggcaggtgcgtcctcggatcaggtgaaggctgtggaggaaattgcggctaaggtggggctcgctttccagatacaggatgatatactggatgtgacaggttcagcagaagaactgggcaagccgattcacagcgatgaaaaaaatgagaagacgacctatgtgacatggaagggcatcgacggtgcaaaagtgctggttgacaagctttcacgcgaggcgcttcagcagatggaaggcctgggggctccggacgagtatctcgcacaactgctggtgtccctgataaacagaagcagatagagagggattcctaatgatattagaaaagatccaaaaggaaaatgatataaaggagttacagcctgaggacctggatctgctggcggaggagatccgtgagttcctgattgaaaagatcagcaggacaggcgggcatctggcctccaatctgggcgttgtggagcttacgatggccctgcatctggcctttgacctgcctcaggacaagctgatctgggacgtggggcaccaggcatatacgcacaagctgctgaccgggcgcagggcaggattcgatgacctgcgtaaatacggcggcatgagcggatttccgaagcgcaaagaaagtgaatgcgatgcatttgataccgggcacagctcaacttctatttccgccgggctgggttatgttgcggccagggatattctcggcgaagatcaccatgtcgtctctattatcggggacggcgcgatgacaggcggaatggcatatgaggcgctcaacaatgcctccaggctgaaaagcaattttattatagtattgaatgacaacaacatgtctatctcggagaatgtaggcggcatgtctaggtatttgaatggcctgcgcactgcagaagcctatgtgggtctaaaaaaaggcgtggaagatacgcttttgaagattccggttcagggcgagaaaattgtcaaccagatgaaaaagacaaagagtggcatcaaacagctcattgtaccgggtatgttttttgaggatatggggatcacttatctgggaccggttgacgggcatgatgtgaaaaaattatataaagcgttgaatgaggcaaagcgtgtagaccatgcggtgcttgtccatgtactgacaaaaaaaggaaaaggatatgagcctgcagagaggaatccggcgcgttttcatggaaccgggccttttgacatagagaccggggccgccagggctgcttcggccaaggacagctatacagatgtattttccaaggtgatctgtgatgttgccaggcatgacagtaaggtggcggcgatcacggcggccatggcagacggaaccggactgaaccgttttcagaagtattacccggaccggttctttgacgtgggaattgcggaagagcatgccctgacgtttgcagcaggtcttgcggcgggggggatgaagccggtagtggcgctttattcttccttcctgcaaagagcttacgaccaggcgatccacgacatctgtctgcagaagctgccggtagtgctggcagtggacagggggggacttgtcggcagtgacggagagacgcatcagggcctttttgatttatcttttctagccacgatccctaatatgacgattatgtcgccgaaaaaccgatgggagatggcagatatggtcagatatgctgtgaattttgggtatcccatagccctgcggtatccaagaggaacagcttatgaggggctgaaggaattccgtgctcctattgcctatggcaagagtgaagtcctctttgaggaagaagatattgctgttttgtttgtaggacacatggctgcggttgctgaggctgtacgttacagcctgaaagacataggatacagctgcagtctggtgaacgcacgctttgtaaagccgctggatacggaaatactggagcggatggcggaagaacatcagctgttcgttacgattgaggagaacgtcctctccggaggctacggagagcgtgtgctggaatatgtgtcacgtgcgcgcctcggggtgcatgtcctgaatatcgggataccggacgattatgtggagcacggcaacgtggatgtactgcgccacgaggttgggctggactgtgaaacaatcgtaaaacaggtaattacagactatgtgacgataaggaatgagtaggatgaaagaacgattagatgtgttactggtgaaacggaatctggcggagtccagagaaaaggcaaaagccattatcatggctggaagtgtctttgtagatggggagagagaggataaggcaggttcttcttttcctgcggatgtgcggatcgaggtaaaaggacatgctctgccctatgtcagccgcggagggctgaagctggagaaggctcttgccaattttgatgtcacagtcgaaggaaaagtctgtacggatgtgggatcctccacgggcggatttacggactgtatgctgcagagcggcgctgtgaaagtcttcgccatagacgtgggacggggccagctggactggaagcttcgccaggatgaacgggtcgtctgtatggaaaagacgaatatccgctacgtgacccctgaagacattggggagcctgttgatttttcttctatagacgtgtcttttatatctctcacaaaagtactggaacccatccgcggctatctgcggtcagacggggagatcgtggcgctgatcaaaccgcagtttgaggccggccgggaaaaggtaggaaaaaagggcgtggtgcgtgaaaagagcacccaccatgaggtaatcgaaaaggtggcgcagtatgcgaataccatcggctttgaagtgttgaatattgacttttccccgatcaaagggccggaaggcaatattgaatacctgatccacctgcgcaaatgtgaagggggtgccccggcaattgcggtggatctggtgactgtagtagatagggcttttgagacgctggcaaaataagaggaagcaccatggataaattttacgttattacgaataagctaaaagatgctgactacagcataacaaatgaaatcctggattatatcgaacagcatggcaaaaccgggatactctcccagaaggacccggatgggcatattataccgggaaccgtcccggaagggatggagtgtgcccttgtgctgggcggggacggaacgctgatccgcgcggccagggaactggagggatataatatccctctgctcggaatcaacctgggtacactgggctatttgaccgaggtggaactgcatgacttcaggggcgctctggacaggctgtttgataaaacacctgagatagaggaacggatgatgatgcatggctgtgtggagggccggctgaacgacgtggcgatgaatgatattgtagtgacaagagaaggcgggctcagggtgattcattttaatatctcggtaaacggtgaactgctcaacagctatcaggctgacggtgtaatcatctccacccctaccgggacaaccgggtacaacctttcagccggaggaccgattgtggagccaacggcaagcatgtttgtcataaccccgatctgttcccatgctctaaataccagcagtattgtgctgtccgcggaagatatcattgaagtggagatttgcgaggggcgttacggcaagacggaacatgctgccgtcacatttgacggcgccagtaccgtgccgctggtgacaggagatagaattacgatcgaaaagtcgggtgagactacaaagctgattaagctcagcaaggaaagttttatgaagacaatgcgcaagaaaatgaaaggaaactagtaatatgaaagtcagtcgtcatgcaaaaataatcgaattaatcagccagaatgatatcgaaacccaggaggaactggccgagcgtctgaacgatgcggggtttaaagtgacacaggcaacggtatccagagatatccgggatctgaagcttaccaaggtgtccgtggacggcggcagacagaagtatgtggttctgaagccggaggaagacggaatgagcgagaagtatatccgtgttttaagggacggttatgtatccatggatatggctcagaatatcctcgtgatcaaaacggtatccggtatggctatggcagtcgctgccgcagtggatgctatgaagtggaaagaagttgtgggatgcatagcaggggatgatacgattatgtgtgcagtccgcagtgtggatgagacagttgctgtaatggagaagattcggaagattgtgtctaaagggaattaggataaaaatatgttgcaaaatgtgcatgtgaagaatttagcgttaattgacgaaatagaagtagaattccagccgggacttaatatcctgactggtgagacgggagccgggaaatcaattattctgggctctgtgagccttgccctgggaggccgatacagcgcagatatgctgcgcaagggcgcacagttcggactggtggagatgacctttaccgtagaggaccaagcggttcaaagacagttggaggcactagacgtctttccggaagaaggcatgctgattctgtccaggaagctgatggagggacgcagtgtcagcaaaattaacggggaaacggtcagcatgagtgtgctcaaagatgttgcaagtatgctgattgacatccacgggcagcacgagcatcagacgctgctgcacaaaaaaaaccatctggcgcttctggatgtctatgccagggataaggtggaagccttaaagaaatctacatctgcggcatataaagaatatatcggctgccgcagagcactcgaggagtcggggatggatgaagaaagccggaaaaaggagatttcgctcgcggaatttgaaattggggagatcgaagaggccggcctgcaggaacacgaagacgaagaactggaggctttataccagcgtatgacagagagccgccgttttacagagagcatagcggaggcgtatcagtatacgagcgaatcagcccatggcaatgccagcgatctgctgagccgggccatccgcgcatttcaggatgtggaagaatgtgatgagcggggagcgggcctttatggccagctgttggagatagacagtcttctgaatgattttaaccgggaattggcggaatatgcgaaaagctttgaattttccgaggaagagtactatgaaaccgagagcaggctgaatcttgtcaatcatttaaaagcaaaatatggtaatactgtcaatgatgtcctggaatactgcaggacaaaaagagagagactaagtgaactaaaagattatgaaagttatatagctgatctggaagaaaaatacagccaaagtgaaaaaaagctaaagaagcactcagatgctttaagcaaagtcagagccgaggcttcccgggcattcgctgcggaaataaagcagggtcttgctgacctgaattttctggatgttaagtttgaattgagattgggaaagacggaaacttttactgctaatggcatggatgaaggggaattttatctttccacaaatccgggggaacctgtaaagccacttgccaatgtagcatccggcggtgaattatccagaatcatgctggcggtaaaagcagttttagcagataaggaagatacgccgactttaatttttgatgagatagatacgggaatcagcggaatcactgcaggaagagtagcagaaaaaatgcatgttatcgggcggagcaggcaggtgatctgtattacacatcttccccagatcgcggcgatggccgatgcgcattatctgattcaaaaagatacaacgtctaacagaaccaaaacggaaatactatgtctggatgaacaggaatcggtcagagagctggcacggcttctgggcggggcgaaagtaaccggaaaaataatggaaagcgcggcagagatgaaagaaatggcaaagcgtgaaatataataccagtgtgaaaaagaacatgcagtcacatactaaaaacggataccatgctggtatctgttttttgtttaataggatagtgttttttgtgaaataagaaattttcgtggtttctatttcacgaattcctgattaaaaatgaaagggtgtggttgcatggagaaacgctggcagaacagagttcttattcttttgtccgctgtgcttttgtctgcctgttcaggctattttggctggatagccgcagatgcagtagagcagacggaagtaagtacagagacaatcagcgaagacacggttcttgtcggcggaatgccggtgggaatctatatggagacagatggcgttatggtactggatacggaacacataaaaggaattgacggggtggaatacgagccggccagccatctggttaaatgcggggattatattactggaatcaacgggaaaacagttgagaataaaaaggaattgatggaagccctcgcccatttgaatgaagacgaggttgtcctcagcctcagaagagaggaagagaccatagatgtgaaaataaaacctgtggaatgtgaaccggatgaatataaattggggatatgggttagggacaatgtgcagggacttgggaccattacctttctaacaggaagcagtgaattcggcgcgctgggacatggaattcatgattcagatacaaatgtacttttgtccattgcggatggcacactttacaaaaccagtatccactcgattaaaaagggggagaatggaattccaggcagcatggaggggatcatagtttataacggatacaataagctgggaagcataaaaaaaaatacggacgcaggtatatatggtacgatagataagatagacgatttatttacagaacagattcctgttcagattgcagccaaagaagagatagaaatcggtgatgcgacgatacgttgctttgtcgacaatgaagtccaggaatacaacataaaggtgacagatatcgactattccggacacgaagtgaataaggggcttgttattcaggtaaccgaccccggactccttgaaaagactgggggaatcatacagggaatgagcggaagccccatcctgcagaatggaaaactgattggcgcggtaacccatgttttcgtacaggattccacaaaaggttacggcattttcatcgaaaatatgctggagaatgttggagatcagactttgtcgaattagagcaacaaattatccttgattatggtgtgattcaaagatataataatcgagtggcgtttctcagtccgggtcctttagaggagagagggattatggaacatttaaacgtggccatcgctgatgataatgagagaattttggatctgctcgaagaaattatcaacatggacaaagaactgaatgtggtgggaaaggctaaaaatggtgaggagatgtgtcaaatcatcaagaatcaacagccagacgtggttcttcttgatctaattatgccgaaaatggacggtttaaccgtcatggagcgcataaatcaagacaagaccatgacaaaacgccctgatttcattgtcgtaacagcggtaggacaggagaaaattacagaagacgctttcaacaaaggcgcaaattactacatcatgaaaccatttaataatgaaatgttgttgaatcgtataaaaactgtaagaaaagtgttccgaaatcacgagaagaaaaatgaagaattatctggaaacacctcgatcagagaagaggacctggaaaatcgtgtcactaacatgctgcatgagattgggataccggctcatatcaaaggataccattatctgagggatgccattatgatggcagtggaagatatggatgtcctgaacgcaattacgaaggtattatacccaacggttgccaaaaagtaccagacaacatcaagcagagtggaacgggcaatacgccatgcgatcgaagtggcatggaaccgcggcaaattagacactctggatgaattatttggctataccgtgagcaccggcaaaggaaagccgacaaattctgagtttatagcactgattgcagacaccatccaattagaatataagcacagataattctttcctttgttcagaaaatgagttataatagtcagtgtataaggcttgtaagaggactcaaggaaagtggaggggttgtttatgaaaaacattttatttgcatcttcagaatgcgttccatttattaaaactggcggattggcagatgttgtcggctcattgcctaaatattttgatagaaaaaaatatgatgtaaaggtggtgctgccaaaatacacttgtatgctgcaaaaatggaaagatatgctggaatatgttgatcatttctacatggatatagctggaactgaccaatatgtcggaattttaaaatgtatccatgacaatattacattttattttatcgacaacgaacattatttcggcggttacgctccatatgatggcgatccgaaatggaacatcgagaagtatgcatttttttctaaagccgttttaagcatactacctgtgattgggttccgccctgacttgattcactgccatgactggcagaccggcctcataccggtatacctggataatttccgttatctcggcgagtattacaggggaatcaaaacaatcatgacgatacataacctgaagtttcagggtgtatgggataccacgaccgtgcgcagtatcacggggctgccggagtactattttgttcctgacaagatggaagcatacaaagatgcgaaccttctgaagggcggaatcgtatatgctgacaaagtgacaactgtaagccaaacttatgcagaagagattaaaacaccattttacggagaggcccttgacggcctgatgagggcgagagaaaatgcactgtgcggaattgtaaacggacttgattatgaggaatactgtccgtttctggattcccggattgccaagaagtttacggttgatacattccgtaagaataaagtggcaaacaagctggcccttcaggaagaactgggactggataaggattccagaaccatgatgattggtatggtgtccagacttaccgatcaaaaaggatttgaccttgtagattacattatggatgaattgtgtcaggatgcggtgcagattgtcgtactcggcactggagatgccaaatatgagaacatgttccgtcattttgcatggaaatactcgggaaaagtgtcagcgaatatcttttattccgaagacttatcccataggatttatgcatcctgcgatgcgtttctgatgccatcattgtttgagccatgcggattaagccagctgatgagcctcagatacggaacgattcctatcgttagggagacaggaggactgaaggacacagtagaaccgtacaatgaatttgaaaaaaccggaacgggattcagctttactaattacaatgcacatgagatgctgaataccatccgttacgcagaacggatctattacgataagaaacgtgactggaataaaattgtagagcgcgccatgaacaaagatttttcatggaagaactctgcaaggcaatacgaagaattatacaaaagcctgatcagtgaataaagcgcatgggctgccctttttatgaagggcggccgcaggcattcgtataagggagaacaagtaaaatatgaaaataaaagacagactgaatgagaaccggatacatatatcgttcgaggtgtttccgcccaagacagacgcgggatatgaaaaggtacaggaagcaaccgacaggatagccgccctgaaccctgactttataagtgttacatacggagcaggcgggggaaccagtaaaaacaccgcaaagattgcggagcatatcaaagaggatctgggaatcgaaagcctggcacatctgacctgcgcgtcctcaacgaaagacgaggtgaggagtgtaatcggcagcctgaaggaacttggaatcgagaatattctggcacttcggggagacattccggctgatatgcaatttccgtcggaggatcgttttcactatgcctatgagctggtagaagagatccggaagcatggagacttctgcatcggcgctgcctgttatccggaaggacatgtagagaacgaacataaagcagatgatataaaatatctgaaacagaaggtagacagcggtgtggattttttgaccacacagatgttttttgaaaatgatatccattacaactttctgtaccgaattcgggaagccggcataaccgtacctgttctgccgggaatcatgcccattacaagcgcaaaacagatgaaacgcagctgtgaactgtcaggaaccgtgtttccgcggagattccaggctatactggacagatttggagactgtccggacgcaatggagcaggccgggattgcatatgcgacagatcagattattgacctgcttgccaacggcgttaggaatatccacatttattccatgaataaaccagaggtggcagaggcaatcatgagtaatttatcggaaattattaaatgctaggagtaataacagatggatcatatgacaaaagaagccatccgttatctgggatatggaaaacatgcggtagatgataagacgcttgcaatggttgaagattcattcagggatctggaagacatagcaggcagaagatccatctaccgcatctttgatttgcagcagacggcggatgacagatttacgataggcagagtagaaattcagagcagaaatcttggacggaatctgaaagggtgctgtaagattatcttgtttggcgcaacgctggggacagcggtagaccggatgcttgcccgcctttccttaacggatatggcgaaggctgtagtgatgcaggcctgcgcggctgctctgctggaagaatactgtgacgcgtgccaggcggatattgctacggaggtctcagtgcaggggctatatctgcggccaaggttcagtcccggatacggtgattttgacattcgctgccaggcgcctttgatgcagctgctggattgtgcaaagacgattggcctgacaatgactgagagctgtatgatgactccgtcaaagtctgtgacagcggtgattggagccggtactacagaagaaaaatgccacatcaaaggctgtgaggcctgcgaaaaagaagattgtatatacagaagggataaaatatgattttagacagattgggaaaagaactgctgttttttgacggtggaatgggcacattactgcaggcgggcggcttaaagcccggtgagcttccagagacatggaatatctcacatccggaacagattatggagatacaccggaattatatcgaagcagggagtgatattatactgacgaatacatttggggctaatgcactgaagttccatgatgacagctgttcactgcaggagatcgtatctgccgcggtaagaaacgtgaaaaaagcgtctgcgcaggctgccgtgcatgggcgaagcgtttatacagcactggatatcggccctacaggaaagctattaaagcccatgggggatctggagtttgaggaagcgtacgaggcattcggggaggttgtaaggtacggaagcgaggccggagcggatctgattcatattgagacaatgagtgatacatatgagttgaaggctgctgtgcttgccgcgaaggagaatacagacctgccggtgtttgtgaccaccatttttgacgagcggggcaaactcctcacaggggcagacgtaccagcggtggtggcactactggaaggcctgagggtggatgccttaggaattaactgcgggcttgggccaaaacagatgcttccgatcctggatcagattctggagtacacgtctcttcctgtgattgtgaagccgaatgcaggactcccgaaacaagtgaagggagagacggtctatgatgtacttccccgtgattttgcgtctgtcatgcagatgattataggccgtggcgcgtctgtagtgggcggatgctgcggcacgacgccggaacacatcagggcgatggtaaagctgtgcaggggaatgaaacccgctccggttacgcagaaggaaatcacgatcgtatcctcttatggcagatcagtctgcctgggtacgggatcgaagattatcggagagcggatcaacccgacggggaaaaagaaattccggcaggcactaaaagaacatgacatagactatattcttagggaaggcatcacgcagcaggataaaggcgcgcatatactggatgtcaatgtggggctgccggacattgatgaggtatccatgatgcgggatgttctgtcgggactgcagagcgtgaccagcctgccgctgcagatcgataccgtggatacaaaggccatggaagccggtctacggatctacaatggtaaagccatggtgaattctgtcagcggcaagcaggaatccatggacgctgtatttccattgatacaaaagtatgggggcgtagtcatcggcctcacgctggatgagagcggcattccggatactgcggacaaaagagtggagatagcccgccgcattatcgcggaagctgcaaaatacggaattcataaaaaagacattgtcatcgacgttctggctatgacaatcagttcggatccggaaggggccagggtaacgttggaagcattgaaaaaagtgcgttacggacttggagtcaacacggtgctgggagtatccaatatctcttttggcctgccgaaccgcccggttatcaatgccaatttctatacaatggccatgcacaatggtttgagtgcggggataatcaatccttcctccgaggaaatgatgaggtccttttatgcatatcatgcgcttatgaatctggacagtaactgtgaagattacattgcgaaatatgccggacaggacactggcaccccggcggctccttccgtttccggggagatgtccctggatcaggcgatcgaaaaggggttgaaagaagaggcgcatcatattacaggcctgcttgtaaaggagcagaaaccgctggatatcatcaatacgtatctaattcctgcgctggacaatgtggggaagggctttgagaagggaaccgtatttctgccccagcttctgatgagcgctgaggcggcaaaagcggcttttacaattctgaaggaatcgcttgcggcggctggacaggatcaggagaagaaggagaaggtggtgcttgcgaccgtgaaaggggacatccacgatatcgggaagaatatagtgaaggtactgcttgaaaactacagttttgatgtgattgacctgggaaaagacgtggcgccggaacggattgtggagacagtggtgaaggaggatgtgcgtctggcagggcttagcgcacttatgacgactaccgttgtgagcatggaggagacaatcaagcaattgaagcagaaagctcccagatgcagggtaatggtaggaggggctgtcctgaatcaggagtatgcggatatgatcggagcggatttctatgggaaggatgcgatgcagtctgtttattatgcgcagaagctgcttaagaatcagtaaggaatgtacctttttttatacaagaaaccatattgactaaattttaacaaaagggtatagtggtaatgcaaatgaaagagaatggcagaaagctgcctttttggagaaaattcaggaggaagagaacctatgatgagaggactgcagacaccggtccgtgcaatacggagaagagtgtttacggaagttgcgaaactgggatttaaggctaacgcggacacgctgttggcagatatggaagcgataccctatgagattgtaaatgatgatacggagaaataccgcgagagtacctaccgttcacgcgcgatcgtgagagagcgtttgaggctggccatgggtctgtcgctgcggccggagaataagccggtgcacctgacttccggagtggaagccagcaacatttcggaaaagtattatgagcctccgctgatgcaggtgataccatcggcctgcgagagctgcgaagaaaataaatatgaagtgagcaatatctgtaaaggatgccttgcccatccgtgccaggaggtatgtccgaagggagctatttccttcgtggacggcaagtcctttattgaccaggaaaaatgtatcaagtgtggaaaatgcaaatcggtctgtccgtatgatgctatcgcaaagaaggaaagaccttgtaaaaatgcctgcggcgttaatgcgattgtttccgacaaatatggaagagcctacattgacacagataaatgtgtgtcctgcggtatgtgcatggtaagctgtccttttggagctatttccgacaagtcccagatcttccagctgacaaacgcgctgcaggagggaggagagattgtggctgagattgcccctgcattcgtcggacagtttggggacaatattacaccgagaaacattaaggctgccctgcaggagctgggattctccgaagtctacgaagtggcgctgggagcagacattggagcaatagctgaggcgcatcattatgtggataaagtggtatcaggggaacttccattcctgttgacatcctgttgtccgtcctgggcggtaatggcaaagaaattcttccctgatctgatcgaccagatctcgcaggagctgacccctatggtggcgacggccagaaccattaagcaggagcatccgaacgcgcgagtggttttcatcgggccgtgtgcggctaagaagctggaagcgtcgagaagaaccgtgcgcagtgatgtggactttgttgtgacttacgaagaggtgcaggcaatgtttgacgcgaaaaacatcgacctgaagaagtatgaggcagagtcttctttccacgacgctacgggagcgggccgcggctatgcctgtgccggcggcgtggcagaggccattgagaactgcatcaacgagtattatccggatgtggaagtgaacattgagcatgccgaggggcttgcagaatgcaaaaagatactgacattggcaaaagccggacgtatgaacggatgtctgatcgagggaatgggctgtcctggaggctgtatagcaggcgccggaacgaatataccggtcgcaaaagcgaagaaagctcttgccaactatgttaagaattcttccaacaacattccgccgaaagaactggcggaaattgagctaaaataatatttgaaaaaccgtaccagctatggtatgataggttagaaatacagagtggatccgcatccactctgtttctgttgaccatatactcatcgtttcggatatccggagcgtataaaggcagaataataatgactgccgcagataaagaaaccgggaggactagggttatgcaaccatatggagtgaaccaattaagaaagatgtttttggagttttttgagagcaaagggcaccttgcaatgaagagcttttcattagtgccgcacaacgataagagcctgctgctcattaactcggggatggcacctatgaagccatattttaccgggcaggagaacccgccgagaaaaagggtgacaacatgtcagaagtgtatccggacaggtgatatagagaatgtcggcaagacagcgcgccatggcactttttttgaaatgttgggtaatttttcttttggtgattactttaaagatgatgcaattaaatggtcatgggagttcctgacggaagtggtaggtctggattccgacagactgtacccatctgtatatctggacgatgatgaagcatttgagatctggaataaaaagatggggattccggcggaacggatttttaagttcggcaaggaggataatttctgggagcacggttcaggtccatgcggcccgtgttcggagatttactatgacagaggggaagagtacggctgtggaagccctgactgtacagtagggtgtgagtgcgaccgctatatggagatatggaacaacgtatttacccaatttgaaaatgacggcaaaggaaattatacagagctcgaacagaagaatattgatacaggcatgggcctggagagacttgcttcggttgtacaaaatgtggattccatattcgacgtggatacgatcaaagaactgcgcagccatgtatgcaggctggcagacgcagtatacggaaaagaagaaagcactgatatttccatccgtgttataacagatcacgtacgttctgtgacatttatgatatccgacggtattatgccttccaatgaaggcagagggtatgtactgcgccgtctgctcagaagagcctgccgacatggaagactgctgaatatcgaaggcaatttccttccggcattggcggagaccgtaattgaaggctctaaggacggttatccggagctggaagagaaaaaagactttatcctgaaagtgatagcaaaggaagaggagcagtttaacaagacgattgatcaggggcttgttattttatccgatatgatcgacgggatggagaagcgagcagaaaagactctttccggagaggaagcgtttaaactgtatgacacatatggttttccgatcgatctgaccaaagagattctggaagaaaagggtatgaatgtggatgaagagggattccaagctgcgatggaagtccagagaaagacagcccgcgccgcccgtggcgtaacgaactatatgggagcggatgtgaccgtttacgaatccattgatccgggtattacatgcacatttgtaggatatgataatttaatatttgaatcagagattacggtgctgaccacggagacagaagtagcagaggccctgtcggacggccagaagggaactgtatttgtaaaagagacacctttctatgccaccagtggcggccaggaggccgatacgggcattatccgcactccggaaggggaatttaaggtagaagacacaatcaagctcctgggcggtaaaatcggccatgtgggacaggttgtcaaaggcatggtcaagacaggggataaggcagagctggctgtagatgcgagaaagcgttctttatccgcaagaaaccacagtgcgacccatctgctccagaaggcgctcaggacagtgctgggcactcatgtagaacaggcaggttctagtgtgaatgaagacaggctccgttttgacttcacacatttttccgcgatgagccaggatgaactcaaacaggtagaggaaattgtaaatgagcatattgccgaggccctgcctgtggatattcagaatatgccgatcgaagaggccagaaagaccggtgcgcaggcattgttcggtgaaaagtatggggacatcgtaagggtggtcaacataggcggattttcaattgagttctgcggcggtacccacgtaaagaacacgagtgagattatggcgtttaagattatttccgagacaggcgtggccgcaggcgtgcgccgaattgaggcactgacatcgcagggacttttagactattatgatgccctggagaggaagatgaatgaggccgcaaggctgttaaaggcatcgccggataacctgccggaaaagatcacgcatgtgatgtccgagaacaaagcgcttcactcagaggtagaaagcttgaagagcagacttgcacaggatgccatgggcgatgtgatggatcaggtgcaggaagtgaaaggcgtaaagcttctggctgcagaggtggacggcgttgatatgaatggactccgcgaccttggagaccagatgaaggaaaaactgggagagggcgtagtcgtacttgcatctggaaatgaggggaaagtcagtcttatggtaaccgcaacagaaggtgcaatgaaacagggagcacatgccgggaaccttatcaaagcgattgccggcctcgtaggaggcggcgggggaggccgtccgaacatggcgcaggcaggcggaaagaatccggcgggcatcaaagatgcgcttacaaaggttgttgaagcactggaaggacaactttcttagtttttttgccggaaacagttgacgtttagtgaaaatatgatataatcttttgtagtgcaataaatatacccgaacagtcgtatgatgcacaatacaaggctggaggggaggttaggtgtgagactatgtcaaatgtaatcgttaaagaaaacgagacgttagatagcgctttacgcagattcaaaagaaactgtgcaaaggctggcattcagcaggagattcgtaaaagagaacattacgaaaagccaagcgtaagacgtaagaaaaaatctgaagctgctagaaaacgtaaatataattaatatgtgcagataaatagagtgttgaaaaacactctatttttgtgttttgaggccagcggaggaggcggatggaaaggaaggcaggggtaggagtctgctttgtattttctttatttatttaagatttgtttaagactttccaaagttcgtagtaatgtctgtgaagctatgatatgattaccaatgtaaactaatgggacattaacataagatggagatgagaatatgtgggataaggtgatatttggaagagatttatatcatgtagtactgtggttccttacgtacagtattcttgggtggatagtggaatctatttacatgtccatttgtaataaaaaatggacaaaccggggattttcaaaaggaccgttatgcccgatctatggggtgggggctctgacagtatattttgtgctgagcccttacagtcacaacagagtgttgcttttctttctgggagccatactggccacaacaattgaatgggtgacagccaggattatggaacgaatattcggtgaggtctggtgggattatacggacaagccgtttaattataaagggattctctgcctggaaagcacgctggcttggggactgtatactttgatcttgtttggggttctgcacgggtttgttgagcggattgtaaatgcgatacctttccatataggaagaattgcaggtacattgctgattttgctttatattattgattttgcgtcttctttttataaagagaagcgggagaacctgccggtctcgttcagcaagattaagaacagatttcggaacttgatcggacgttagatggctcttgaagctcttactgtcccccttgcggatgcgcgcagtactgacatcagggtagttactatacacggcccagggcccgcgcataataacggcatctgggccatttaaagtcgcctggggcaagggaccagatgcccggctcgatcactttaatggctcggatgccgtgcagcggggtgcacggccccgtgaatggtagctcaggatatacagttcgaatttttacttgacgttaggaaaaaactggtatatactaaatgagtgaaatgacaaaggcgtcatagacataggtctatggcgtttttttgcacttttacaggagatattagccaagtcatcaggacaaaatgaattattttggctatatcttctataagaaatgggaaaacaatagaaatgaataatacaaatagatttcctgcgaaaatgtcgttttcacataaaacaggggatgagactgtccggatagctgtcatcgtttaaactaaagctaatattgcggtaacacggatgatgtttgaaatgttatgaaagcattttgctgtatactttgttgggtttaatactatacagtgctaaagctgtaaaaattatgaaatttatgattgacaaagttgcagacagcttttaaaataaacgagtagacaaagttgtcatgttgcggggcaggttgtcaccccgccatttttatattatttcaggaggtagaaaaggatgtcatacgttgatgaggtaattgaattagttgtgaaaaagaaccctgcagaaccggagttccaccaggcagtaaaggaagtgctggagtctctgagagccgttgtggaggcaaatgaggagaaattccgcagagatgctcttctggagaggcttgtagagcctgagagacagctgaagttccgtgtgccgtgggtggatgacagcggtcaggttcaggttaacacagggtaccgggttcaattcaatagtgcgattggaccatataaaggcggtcttcgtctgcatccttcagtaaaccttggcattatcaaattcctgggatttgaacagatcttcaaaaattccctgacaggtcttccgatcggcggaggaaaaggcggttcggacttcgatccaaaaggaaaatcagacagagaagttatggctttttgccagagttttatgacagaattgtgtaaatatatcggagcagatacagatgttcctgcaggagatatcggcaccggtgcaagagagattggatatatgtatggacagtacaaacgtatccgcggattatccgaaggtgtacttacaggaaaaggattaagctacggcggatctctggcccgcacagaggctaccggatacggtcttctttatctgacagaggagatgcttaagctaaacggaattgacattgctggtaagacagtagcagtatcaggttcaggaaatgttgctatttacgcaacacagaaagcacatcagctgggggctaaagtagtgacagtcagtgactccaacggatgggtatacgatccggatgggattgacgtagacacgctgaaggaaatcaaggaagttaggcgtgcaagactgacagaatacaagaattaccgtccaaattccgagtaccacgaaggaagaggcgtttggtcagtaaaagttgatatcgcactgccatgtgcaacccagaatgaacttctgctggatgacgcaaaggcacttgttgcaaacggatgtattgcagtagcagagggcgctaacatgccgacaactctggaagcaacagaatatctgcagaaaaacggtgtattatttgcacctggaaaggcggcaaatgctggcggtgttgcgacttcagccctggagatgtcccagaacagtgagcgtcttagctggacattcgaggaagtagatacgcagcttcagagaattatggtggacatctgtcataatatggcggatgctgctgaaagatatgatgtaaaaggaaactatgtcgtaggcgcaaacattgcgggatttgaaaaagtagtagacgcaatgacggcgcagggcatcatataaatcgggatttagtcggcaagcttcagccttgtcgacggacggggacgcttcatgacagggaggccggggaggtgctggggctgtatatgccgttgcgatatgcacccatgctgctaagtgtttctagaacagccgatgccggataggcgggtactctgaacacatcacgggaaatctgatgatttcccgcgctgggttcagtaaaaacttgatttggagatcaagtttttccccgcctatccggcatcggctgttcaagaatcactaagcgcactccagcatttcgcaacggcatatacagccccagcacctccccggcctccctgtcataaagctggctcatccaatcggcaggaaagctcgccaaccgggtaggatcccggaccggggcagcggatgggacagaattggcgggactttaatatagattgtaagttttaaacgcttttttaccttactgattactttacgccaacctaattattaataacttactggggctatcaaatccacaccaattcaataccatccgctgcccccgtttgaggccccatcttagtaacgggtcctaacctaccggccggatgaaccagcttaccgtgagccgggagatgctgctgcaagtgcctgccctgttggaaatgcatgttagcgagcctggcagcagttagaggaaatccgcagaaccagccggaaaaaagctgctcccgaagcagctttttagaacacctgaagcgcttaatcatcagattaagcggtgaatgtgttcggttccggctggttttgcggatttcctcttactgctgcctggcgcagcgggctgtatttccaacagggcagacacttgccgcagcatctcccggctcacggtaagcgtccccctccatccgccccgggactaaagcccgttgctaaatcccgattttatggatatttatggtggaatctgttataatgattagcgaatagttttggctggagttggaggatgtggtatgaatatttttgatattttgggccccgttatggttggaccttccagttcccataccgcgggtgcggtacgaattggctatatcacccgcaggctgttaggaagcagaccggtaaaagcggagatcgggcttcacggatcttttgcggcgacaggaaagggacatggaacggatcgggctgttgttgcggggcttttggggatgaaaccggatgatatgcggatcccggatagtttccgggtggcggagcaggaagggctggaattccaaatacaaaatgtacagatacgggaggcgcacccgaatacagcgcttctgaaagtgtggggggaagagggacacacggtagaggtacaggcctcatctctgggcggcggacgaattatgctgaataaattggacggaattatggtaaactgtacaggagaatgtccgaccctgattgtacagaatcatgacaggccggggcatgtggcggctgttgcatccatgctggcggaggattcgattaatattgccacgcttcagctttaccgcgggaagaagggtggtgacgccgtgatggtaattgagattgaccagcgtgtgccggaggcttctatcagatggtttgaacaacaggatgggattatgaaagtgacatatattgacagggaggatgcatagatggcttatcagtctttggaagaaatcaggcaggtctgctgcgagagggagattcctttctggcgggctgtgctcctggatgatatgaatgagcggaccgtcagcgaagaagaatctgtccagacgatggaggcgatgtgggacgccatgctgcgttccagcgactcctatgatgaaaaactggtttccagcagcgggctggtcggcatgatgggcggacagatggaaaaataccggaaagagggcgatactctgtgcggggattttgtgtcaagagtgatcgtgcaggcactgcagatgggagaatccaatgcctgcatgaagcgtattgtagcggctcctacggcaggggcctgcggtgtgattccggctgtgcttgtgcctttgtaccgggctggaaaggcggacagagagcagatagtgcacagcctgtatgtgacagcgggaattggacaggttatcgcatcccgtgcctttatcgctggtgctgccgggggatgccaggcagaggtaggtacggcttcttccatggcggctggcgctctcgtttacctgaaaggcgggaacaacagccagattatgcatgcggcagggatggccctgaaaaacctgcttgggctggtttgtgatccggtagcagggctcgtggaggttccctgtgtcaagcggaatgtgatcggagctgtcaatgcactatcttcggcggacatggcgctggccggtattacaagcaggataccgccggatcaggtgattgatgctatgagggaagttggagagtctatgcatgtttctttgcgcgagaccggaaagggcggagttgcaaacaccccccgggcaaaggaaatagtggaacatctgggaatgtgaattcaaatatgaattggaattttcccttgacatatcagggcttgctgtattatgataatcactaatagaagggagtaactggcgctctttggagcgttcgcgatgtcgtcaggacgatggccttccatccgtatcgtgattaaatggtgagacttttattgcattacataacatgcaataggagtctctttttttgtaccattcagtggaaaaggccccatattgcataaagaaatggaggatcatacatgaaagaattttaccagatttctgcagaggaaacgaaacagaggatcaatggaaccatggaaccactgactgcagaagaagtgaaaaagcatcaggaaaagtacggcccaaatgagctggtagaaggtaagaaaaagacgacagtacagatatttctggaacagtttaaggatttccttgtaatcattctgattgtggcagcaattgtctcaggctttctgggagacgccgagagcgcggtagttattttgatcgttattacgattaatgcgattctgggaacagtacagactgtaaaagcggaacagtctctcaacagtctgaaaaagctttcgggaccggaggcaaaggtactgcgcggcggcaatatcgttccgattccctctacagaagtaacggtaggggatattgtcatgttggatgcaggggattatatccctgctgacggacggcttctggagtgcgcaagcttaaaagtagatgagagcgctctgactggagaaagccttggagtggataaaagtacagccgcgattgaaggggaggttcctcttggcgacagaattaatatggtatattcgggcagcttcgtgacatatggccgaggttcatttcttgtaaccggaatcggtatggaaaccgaggttggaaagattgcgagcctgctcaagacgacttctgaaaaacgtacccctcttcagataaatctggaccagttcggacagaaactgtccattattatcctgatattctgcgcaatcctatttggtattaatgtcctgcggggcggcaatatcggcgatgcctttctcttcgctgtggcgctggcagttgctgcgataccggaggcgttgagctctatcgttacaatcgtgctttctttcggtacacagaagatggctaaggagcatgcgatcatccgaaagcttcaggcggtggaaggactgggcagcgtgtcaattatctgttcagataagacaggaacactgacacagaataaaatgactgtggaagattactatgtgaacgaaacgcgggtacctgctagtgagatcgatattaaccatccggcacacagtaagctgctgctgtgcagtatactctgcaatgattctacaaatgtagacggtgtcgagatcggggacccaacggaaacagccctgattaatatgggaagccgtctgggcgtatacgctcaggatgtgagggaaaagtatccccgagaaagcgaaaatccttttgacagtgacagaaagcttatggcaacaaagcatacaatagatggaaagcatgtcatgattgttaagggcgctgtggatgtactgcttaatcggatggagtcgatacagatccaggatgaagtcagaaaatttgagcaggcagaccgcagtaaaattgaagcccagaaccaggaattctccaggggcggcctgcgtgtacttgcatttgcatataaagagatcggggagaaccaggaattgactctggaagatgaagacaatctgacgtttgtaggactgattgccatgatggatcctccgcgtgaggaatcaaaggcggcggtagccgaatgcaggagagccgggattcgtccgatcatgattacaggagatcacaaggtgacagcggcagccattgccaagagaatcggcattttggaagatgaatcagaggcatgtgaaggcgcagagatagatagtatgtcggatgatgaattgaaagatttcgtggaaggtatttctgtttatgcacgcgtatctcctgaacataagatcagaattgtcagggcgtggcaggaaaaggggaatatcgtatctatgacaggcgacggtgttaatgatgcgccagccctgaagcaggcggatatcggtgttgctatgggaatcacgggcagtgaagtatcaaaggatgcagcctccatggttctgacagacgataattttgcaacaattgttaaagcggttgagaatggccggaatgtctaccggaatattaagaattccattcaattcctgctatctgggaacttcggagctattctggcggtgctgtacgcatccattgccggtcttccggttccttttgcaccggtgcacctgctgttcatcaacctgctgacagacagcctgccagcaattgcgctggggctggaaccgcattcaaaagatgtgatggatgaaaagccaaggcccatgaatgagtccatactaaccagggatttcctgactaagatcggaacagaaggcctgtgtatagggattacaacaatgattgcttttctaatcggataccgtactggcaactccgtactggcaagcacgatggcttttggcacgctatgtactgcaagacttgtacatggttttaactgtaaggcagaccgaccggttgtatttacaaaaagggtattcaataacatctacctgattggggcttttttgctggggcttgtattaatcactggggttatggttatacctggccttcaaaatgtatttaaagtacagtcactgaccctgggacagctctttaccgtatatgggctggcggcacttaatctgccggtaattcagctcatgaaggctgtcaaggaggcggtaaggaagcgaaaggcatgatgagaaattgcgccgctgcggccgaaaataggtatcggtgggagcggtttacgggagtaagctgaagaaaagcaaaacgaaagaaaaccggggcagcctggacacatcatgcgaagcatttatggcttctcacgatggggcagggcaaccccggttctatttgattatgtgtgtctttttattgtttctttaaggatatattttttatcgctgtaacggtctacgatgtaactatttgccagatgttccagcttgtctgtcagtgggtccagtgtaagatcttccccgtattttcgtttcaatgccttagcgagcagataatcgcagacgtgagggttcttggggaggagggggccgtgaaggtaagtccctattacatttttgtaaacgactccttcgtaaccggatttgccggtgttgcccagaccatagaagactttgccgaagggtgtgtgttttcctatgtgggtgcggccgccatggttttcaaatcctacaacaggggtgtcgaagagtgggctgttcaggacgatgttgcggattagccgttcaggttcccactctgtagtgatgtccagaatggacaggccttctatgttttttttgtctgttttgtaatatttacctaacagctgataccctccgcagactgcgagtaccacaccgtcgttctctacgtagtccttaaaatcctgcttaatattctgaagctgtccgcagaccagttcctgttcacggtctgaaccgcctccgagcagaataatgtccaattttgaaaaatcaatggcgtcaccggatagaaaggggatcacctcggcttctattccgcgccattccagccgcttgcggaaacattggatgttgccgcggtcaccgtacagattcagaagatccgggtataaatgtccgattgtcagtttcatgctgtggcgcctcctttcccggctttttctaattctgtcagcatatggtttgtactgtaaaggccggaataatttacaatgacatagagattgccggttccattttccgtgcgttcctgaaccgttgcacgcagatttgtggtggaatcacagggaatgtcctcatattttaaccggagccccatatcatggcggcgggtgccggttgtagtaatggtggctgcctgtgcgtcggccagatattgaaagtctacatcccagagccaggagacatcttctccatcctgataggtgtcgttgatctgaatgataatgtctttcggctttttatcctttaatacaagagaaatcttctgttgaaaaccaatggggttttttgccagatggagttgaaccctggcgccgttgatcgagaaaatactctcgcggttattcccgtagtcaaaggtttcgatcatttcctggaaatgggacctgtctgcctcaagtgcattgagcgccgcgtacgcggacagtgtattgtaaatgttgtatggtgtgcgtgcggttgaatggatgtccattccgtccatatgaaatgtataaagctcatcgtgcagttcgatttcggaggccgtgaaatcaggctccgggcgttctaagccgcagctggggcagtgatagatacccagctgtccataatggaagaagtcatattccagcttcttgccgcaggaacggcagaagatgctctcccggatctcggaacgggaaatgtcgtcaaatatctgctcactgatgccgtaagtgataaacggattctcactttcagcggcaagggtataggacaggacatcatcgcagttaatgatcagttttgtgttcggtacgctggtgacggctgtcttcaacttatggaaagtgatgtcaacttcgccgaatcgatccagctgatccctggagatgtttgtcagaagagcacagtctggtttcagttgggggagcacgcggacggaagcgatctcatccacttcgatacaggcataatctgcatccagcctgcagtgcttgtcagaggcaagcacaaaggcagaaataattccattgagcatattggctccggtacggttaataataacttttttcccttctgcttttaatgcatgatacagaatactgtttgtcgttgtttttccgttcgttcccatggttacaatcgttttttctttcaccatttccgccatggcggataagatacggggatcaatgatccgagcaacatagcctggcagggtaacgccgcttcctctattcagttttttaatcagatagcttgtgcatttagcacatttaattgcgagtatgcttcttattctcataatcttatatcaactcttatccttttcttgaaatacttgtactattataatagaaacgaatgcagaaaacaaggaatttgaaaggatttcggcattttgcaggtacttgttactatgcacggcctatgggccgtgcatagtaacggcacagaactatattttgtgggacatgcaatttttagcgaaagaaattataaagatttaatgaagcctctggaaattcattttcagtgtgatagaatggaaatgactaaaactggtaaataccgaagatatagaatctgagaatgaggtggaataagatacatgcagaaaaaaagcagagaacaggtgattgaggagaaaaaagacaggaggattccgacaaccagataccgccccgagtaccgtcaggggctgacgaaccagcaggtgcaggaacaccgtctgcacggctggacgaacacggcggtggatccgccggccaagacaacgaaggaaatcatccacagcaatgtgtttacgtactttaacctgatatttgtaattcttgctattcttttatgtatagcgggatctttccgtgatctcacatttcttccggttattatactgaatacattgattggtattgtacaggaggtgcgggcaaagaaggtgctggatgacctgacgatgctgaatgcgcctcacgcaactgttgtgcgggatgggcagaagtctgtgattgacgcggaagagctggtgcttgatgatattgtgatctttaaggcgggcagccaaatatgtgcagatgcggaagtctgtgccggggaggtacaggtaaacgaatcgctgctgactggagaatccgatgagattgtgaagaagaaaggcgacgagctgatgtcaggaagcttcgttgtgtccgggcagtgccatgcaaggctggaaaaggtcggcatggattcctatatctcaaaattgactatggaagcaaaggaaatgcaggaaggagagcagtcagagatgatccgctctctggataagctggtaaaatgcgtgggtattgcgatcataccgattggaattgtactgtttgtccaggcatttttctttcagaatgaaggctttcagtccagtatcacttccatggttgcggcaattatcggcatgatccccgagggcctctatctgctggcgagcgtggcgctggcggtcagttcggttcggcttgcccagaaaaaagtactgcttcatgatatgaaatgtatcgagacactggctcgggtaaatgtgctctgtgtagataagacaggaacgattacggaaaatacgatgaaggtgcaggaggtgattcctgcggacggttacgatgagaaagagatgcagcctttgagcatgctgatcggagactttgcggcggcgatggatcaggataatattacaatggcggctatgaaggaatattttcagtccgcatcgggtaaaaagccgctgagtaagacagggttttcttctgctacaaaatatagcagtgtcacctttgaggatgaggtttacgtactgggagcgcccgaattcgtattgaaggacaagtatgaaacctatgaggaagaaattaccggatatgcgtcaaaaggcgccagagtcctggtattcggcctttatgacggtgagattgacgggaaagctttggaacaggggattaccccattaggatatattctcctggcaaatcccatccgcaaagaggcaaaagagacatttacctattttgcagagcagggcgttgaggttaaggttatttccggagataaccctgtgacggtatcggaagtggcaaaaaaggccggcattgccaatgcggagaactatgtagatgcttccgcccttacatctgatgaggatgtccgtagggcagtgcttgagaataccgtattcggcagggtaacgccgaatcaaaagcggcagttcgtccaaattttgaaagaggccgggaaaacggttgcgatgacgggggacggtgttaatgacgtgcttgcactcaaggatgcagactgcagtatagcgatggcttccggaagcgaagccgcggcccaggcatcacagcttgtattgctggaatccgatttctcctgtatgccccaggtcgttctggagggccggagggtcgtaaacaatatccagcggtcagccagtctgttcctggtaaagaatatattctccttcctgctgtcgttgttctcggttgtatttatgatcacatatccgttggaaccgtcgcagatatctctgatcagcatgtttacaatcggagtgcctgcgttcttcctggcgctggagccgaacaagaacatcatcaaggggcatttcctgacaaatgtattcctgaaagccctgcccgctgcgctgacagatgtacttgcagtgggggcgctggtggtattcgggcagacctttggtgtgaattcaaaagacatatccacagccgcaacgatgctgctggctatcgtcggatttatgatactctataagatcagcgcgccgatgaacatcatgcgcacaatcgtagtagcgggcagcataataggacttctgttctgcagtatcttcctgaacaacctgttcgctataaccggtatgtccacaaaatgtgtcatgctatttattgtattctccatagccacagaacccgtgctgcggtacctaacatccttgttgggaaaactcagaatatactatctgcgcctgcggggaagagtagtggaggagtgaggggatcggcttgtgggggacgcccccccatccctttggtggcattgacgggtgaggcgtatgttttcctttaaacctttttgattaagcaactgcgtagcttaagagttttttgagggtgttttggaactgtttgttttgggaacggagttttagtttttctgtgcttgttctattttgttctacgtaagcgtcgtatttgtcgaacaggaggtggtaatccatgtgctgcttttggccccagtggaccaggacccagttcatggcatcgctctgccagtagctcatggggatttctgccgacctcaggatggagatgtattggatggcctgcatggacagagaacttagctgctcggtaagttctacctcgtatttatcttttttacctaatcttttgaaaattttaagaggaaggccttctttttttgagtgaagttccatcagatttccgctctgtgagacgatctcattcaggcggcaggctgcattccagtaagttacaaaggatgcggaagaatccgccctctcttcctcgggctttccgaccgtatatgtgcggaataccctgttgggctttccaaccagttttcgattgtatttactgcgcctgtccgggttggcgagcgtccggtatgcttcgagtatctcctgcatataagctgtggtgtctatatcattatgcatattggcatccggatggtatacttttgccaatgcatttttcgcgctggtaatttcttcaagggttgcctctctggatactccgagaatgtcatagtatgtacgggtttccatcgtttcctccttattcctgtttcattatttattctcccacaattaatattacgataggatcacaaaaaaatcaagatcgggatttagtgacgagctttagtctcggcacggatgggggacgccaagcgaactgtaagcggcaagccctccggcctgtatggtcggtttaaaatcctgaccgcttaacgaagaagctctaagagacccggaggcacccggaagggcacatccggcatgcgctgaaaaaattgatattttttcagcacaggccggattgaaaattgatttcggagaatcaattttcatcccttccggatgcctccggctctctaagagcttctaatcgtccgctataaggcgttttaaaccgaccatacaggtcgtagggcttgccgcttacagtccgcttggctggttcatccgaccggtaggcaaagactcgttcctaaggtggagcacgagacgggggaggcggatggaattggctatgcgtatcatgcatcttgattaaatggattttaaggcttttatgtatgggagctttgggactgtttttgaagaaataatatttatttagtaacgattatcgtgtgtaactccatattttttttattaatgaaccatacaattttttaaatccagtatatttacgggtaacaaggcgatctaacacttacacttatataaacgaatcaccaattctgttccatccgttgctaccgtacgagggcccctctggggaatgagctcttaactaccgtttggatgcaacagcgaatgacgaggtgagtccgggagctggcggggcaatgtctgctggtgaaaagtccataaagcgagcgattagaagctgttgaagaaaacggaacgggaagggagggcagaatttgccttaccaggcaaattctgatgccgcctgcggcgcgaatgcatcggcattcgggccaaatgcggcatgtacctcccttcccgttccgttttcttctacagcttcttcgcgaagtgtcaggacatttcaccagcagacattgccccgccagctcccggactcacctcgtcattcgcgtcctccatccgtcaacgagtctaaagctcgttaactaactcccgatttattggaacatattttctacgtagttccgcatttcttcccggctgtgtttctgtcttgcttcatcaatcaccttcttctgttcagcatctgatagatgggaaaagtgattcagggcatcggagtgctgtgccagtgccatggtaaaaccgatcggcagttcttcattatttatcattaacaaacctcctttcatgagggaatttaattttagtatgtgttagttttttgacttcatacctgtaaatctgagcaggataatggtatactattaaatgaaaatatagaaatgagggatttttatggtattgagtgtcagccggagaaccgatattccatgctgttatccggattggttttataaacgcgtggaagaaggtactgtctgcgtgcgcaatccattccggccgcatcgggtcagcgagattgcgataacgccggatgtgactgactgtattgtattctggacgaaaaatcccgaacctttgattgcagaattgagcagattggatgaatatttatattatttccagtatactttgacaggatacggaaaagatattgaaccgggacttccagataagggggctttgatagaagtgtttcagaaactggctgggcggattggcaggaaacggatgatatggcggtatgatccgattttgctgaatccttattatacagcccgtttccacctggaggcttttgaaaaaatcgctgggaatctgcaagggtgtacggaaaaggttgttgtgagttttattgatacctataaaaacaccagggaaaatgcggatattttgaagctgaaaaaaacagagccggtagaactggaactgttagcaggtcagcttgcagagatggcgggacggtatggaatgcgcatggcggcatgcgcggaagagatggaatttggcaggacggacatagagcacggggcatgcattgataagagcctcattgaggaacttgccggatgtgaacttgacgccggacgggacaagggccagaggccgggatgcggctgtatggagagcatcgacattggggcttacaatacatgcatgaatgggtgcaggtattgttataccaattacagcgggactgttctaaagtcctgcagggagaggtttgctgtcagttcgccgctgctttgcggcagattaggagcggatgatatcgttacacaacgggcggtgaagtcatggaagaatccgcagatccggcttccgctttaagagaaggagagtgaggcatgtggaggaatctgcccgccgctatgcccgggagattgagcatttggattttaataagaaaaaactggaagaactgttggatgatgaggaaagatttggtctggaaacttttttcctgatgctgtaaggaaagtttgaaacggaggtttggctatgaaagcagttgtttataagggaaacggaatcatatgtctggaagaacgtccattgcctgaaattcaaaaggacacagacgcaattgtaaaggtgacgatgacaaccatctgttccagcgacatacatatcaagcgcggggctgttccacgagcaaaggagaacatcgtactgggccatgaatttgtgggagaagtgatccgaataggaaaagcggttaaaagaatacgcccaggggaccgtgttgccgttaatgtagaaacgttctgcggaaaatgctatttctgccgccacggatatgtcaacaattgtacggataaatatgggggatgggccctgggctgccggattgacggggggcaggcggaatatgtcaggattccttatgccgataacgggcttaccaggattccggagaccgtttcagacgaagccgcgctgtttacaggtgatctgctctcaacaggttactgggcagccaagatgggggatatcaagctttccgataccgttgcagtaatcggggcaggtcctgcagggattgcggttatgaagtgtgtcggactgtataatcctgctaagattatagggattgatatggatgaacaaaggctggacctgctaaggcagcataagatcgccgatgtcaccttaaatccactgagagatgatgtgataaaggccgtaaaagaactgacagacgggcggggagcggattccgtcctcgaggtggcaggaagcagggagacatttgagatggcatggatgattgcaagaccaaatgcggttgtaggaattgttgcaatgtacgaagaggatcaggtacttccgcttccgaagatgtacggaaagaaccttacctttaaaacgggaggagtggatgccgcgaattgcgaggatatcctgcgcctgatcgaaaacggcaggctgaacacggagtgtatgatcacccacaggaccacgctggatcatataatggaagcatatgatatttttgagtataaaagagatggtgtcgtgaagtatgccgttgccgtgtagaaatacagaagaaacagcattttctgcggtctagttgttctaatcttaccctccctctactatattggtaatagacgatatagcagagggagttttatatgaaagcagcactggcggtattattaagcgcactactttgtgtacagaatgcatatgcaatgccggcaaaagagtatattgtctatgaagacacggcagaattacaggaaaatacagaagaggtgcaggcggacgcgcagcaaggcacagaaaacacgcaggacagcgatacggcggctgtagaaagccaggaaaccgtttcggaagatacaggcggtactgagggggaggcggctgacacacagactgctggcccggaagtaagcgcgccgtctgcaattcttatggaggcgtccaccggagaggtcatctttgagaaggatgcggacacagcccgtccgcctgcaagtgtcacaaagattatgactatgcttttgattttcgatgctttggccgatggaaaaatcaagctggaggatcaggtgacaacctctgagtttgcggcatccatgggcggctctcaggtattcctggagcctggggaaacacagacagtagatacgatgctgaaatgtatttccgtggccagcgcgaatgatgcgtgcgttgctatggccgagtacatatccggaaatgaagaagaatttgtcaaacagatgaatgagcgggcaaaggggctgggaatggaaaatacccactttgtcaactgcaacggcctggatgtggatgggcacgtgacaacggcaagggatatcgccctcatgtccagggagatgatcacaaagtacccgcagattcatgactactgcatgatttggatggagaatatcacgcatacaacgaagaaaggaaccacagaattcgggctcaccaacacaaacaagctggtaaggcagtatgaatatgcgactggtctgaagacgggatctacgggccttgccaaattctgcgtatccgcaactgcaaaaaagaacgatattgagatgatcgcggttatcatggcggcggaggattccaaggccagatttaaggatgcgactacgctgctgaactatggatttggaaaatgccaggtttataaggatgagaaaccggaaaagctgaaagatataaaggtagagggcggtgtaaaagagacgataccctgtgagtatgcgggcagtttcagttatcttgacaccagcggagcaaacctggcagggattacaaaaaagctgaaagtaaagaaaagcctggatgctccggtgaagaaggggaataaggcaggaagtctggtttattacctggacgggaaagagatcgggaaagtagatattattgtatctcagaatgtgaaaaaagcgggatttctggattatctgaaaaaagttgtttcacgttttcgaacttagccgattgggctgcattctgtcattcatccgctgttcataccaaataaaatatcacgaaccatgcaggggagctatttgcatggttcgtgatatttttttaatattttataaaacctgaactgctaaaaataaataaccggttatttattctaatgtgtactatacttttgggtgatcacaatcaaaatagtgatgcttcctcatgatttgcagcccctgctgtggagtataaatgtattgttccatttctccgtcctggctgtattcttcgatcggcatcataagggctgtcttctttctgaactctttcagcgtcatgtggtatgcctgctgaaaccgcttattcaaatatttactgtcagagaatccactttccagacaaatatctgtaatattcatatctgtttttttcaatagaagtactgcgtgctcaaatcgtaaagaatttacatattcctgaaaggacattttcatagcgtctttaaaaaaatgggacagatatgttatcgacaggccttctttttctgcaagttccgaaagtgttatttttcccctatagcgctggtggatataggttatgatacgtgtcagcctgcggtccttgttcctggcgttgacgatctctgtatctttcagcatatggtatggcacaaatgctgtgaagtacgagaataacctgtaaaggtcgctgacacagcgaagctcaaaaccaggcgctctaaaacagtagttatagccaaggttaaaacaagtgtggatgatatccagagcttcagcaaatggggtaatagaagtgacattgctggtattaaaacgtatattttggattgcagggtaatgcgcagcgcaaaaagaagggtctgcctggattgtcaaaaggatgcagtcactctgtctgctatgtaatgtatggaactcatccggattaaataatgctatctcaccgggacctaggtcgaattcttctgtgagtgtcttgacatgaaggcctccttcaataacctgcacgatctcaaagtcatggtgcatgtgagggggccggtaggtcagattaatcagaaagaagttgacattgcttacctgcgtatgcgggattctttcgtattcatttacatcatgaatgtggtccatgtttccctccccctttgccattatagtgaattcaagttacattatagataaaaaacagttatttagcaatatatgaacataagataaaacaacaaacttgtcgtttctgtacaacaagttctcctttgtaattcattttaaatatcactatagtatagttatcgatagctaaaaggttcatgaatctgaaaaatgaaaaggagaatcaagcatgagtgataaaacgaaggcaaaggtatcgctgctgctgtcagccatgggaatgatgacatttttggcgccggcggcggtaatagcagctatggttcaggagtttccggataccagtgtatccctgatccagatgattatttctattccatcattgatttctatcccgctggggctggttgcagccagattggcaaaacgctttttaaaaaagacattgattatttttggtacgtgttgttatttggtcggaggcatactcccttatttcttccattttaatgcacaggttattctggcatgctcctgtatcattggcgttggcatggggatcgctatgaccgcgctgatagccctgatttgtgagtttttcgaaggcgcggaaagaggcgggatgcttgggctatatgctgcatttatctcaatcggaggaacggtaagctcactgctgggcggccggttaggagcatctgtatggtatcatgcttttctggcatatttgatcctgataccgattattattctggaatgtattctgctgcctaaaggacatttggatcaggaagaggaaagcggacagctcaagcagagcagacgtatgtcaaagcaggtgtggatgatcgcattgacaggatttgtgttctatgtctgcatcaatgtattcaataataatgcagctgtgctcgtggcagagagatctttggggggcgcggtagagtccagttacatcacgacttgttataccatagcagggctggttacaggattttttgttgggaaaattgttattaagttaaaaaggaagacgattgctgcggcctatacattgggggcagtaggactgctgataggatttgctgggaacagcgtcgtactgatttgcgtgggggcatttataacaggtgtgggcttctgcatgtttgcgtccacggccaacttccacgtatccgagatgagcacgccgagtacactgactttttcccttgcttttctgtcagcgatcatcaatctcggacaggcattttcgccggtcgtagtcaatctgatatcctcaatgatcggaccggatgccggcagccgctttatcatggccggaattggaagtattgcaattgctgtcctggcattgctttttgttaggaacaaaagcagtcacgaagaggtccggacggcagttgtacaggaaggcaactaagaagggaatgtaatgaatagaacaggaggacaaatcatgggatttgtaatgagagtcaaattaacagaaacattaagagacggtaccttaaaaaattattatgaaaacaataggaaggcgggatatcagtttgacttaaggctggcatattaccggggccattatttatcggtcattgatgaactttctgttgaagtggatcatgaaaaaatagaggaagagtccatacggttctgtatcaatgggaaagagtttatgccgtgtcagttaaaggaagcatattacgaattttggagcataaaagatccggcaaccattaaaatcagaaaggaaggcgggctgaaggcaggagagcaccgggttaagctgacacttatgctgcgcaatccatatctgccccagccaggggccgaagataggtacactccggtggacagctgtgatgaaaagatcatgattctcgaagatacaattgcttaagtcagaaaggatggtataaaaatgagtaatataaaattaggtgttacaacgcattcctatgtggcagaatgggttgacgataaagcaactctggaggatatggtgcggcatatagcagaattagggtgcgacggaatggagattgttgcgacctcgatgtttccggagtatccgtatgtcagtgatgcatatgcaggtgaaatcaggagatatgctcaggattatggcgtaaagctggttgcggtcagcggtaatatggaccgtggcaagagaaaagacaggaatctgacggatgaagagatgcttgctgtcgtaatacaagatcttcagaatgctaacaaactggagtgtccggttcttaaatcacaatttttaatctcccccagggtgatgcagagagccgctaaatatgctgaattctatggggtaaaacttacgattgagatccataacccggagacgccttccagccatatcatgacggagtattacaatatgtttgaggagacgggctccgcatatctgggatttgtgcctgattttggaatatttgcagaccggccgaataaagcggacttaaacagagccattgaaaatggtgcggacagagaaattgtagaattagcaacacagcttcgctatgacggtgtatcaagagaggaaggccgtcagatcctgtcggctaaaaatgcaacaccatctgaaatgaacttatttgaatccatgtatggatatatgcagttctcgaagaatcctgactttgatgggttaagaaaaatcatgaagtattgcccgcatatgcacggcaaattcttcgagattctggatgacggaagcgaagctacgattccttacgataaaatcctgagagttttatatgaggaagattatgacggttatgtcgtatcagagtttgaaggacagattaagcccggaaaaagctcctttgattatgtgaagcggcatatccgcctggaacagtcaatactggcggaaataaggggataggaggtgccgcatgaaatacagcttaatgtcgctcatggtcaacgatgagctgaaggtgaagaaaccgaattttatacatatgacgatgatgaaagagtttgggtatgaaggcgaaaatcccacagttgaagaagtgtttgagtttctgaacggacatggtgtgcccatcaaaaatggcagtatgaccttcgaggactatgtgaaatttgcaaaagatgccggctatgacggtatagacatgatggattttcatttagagacggaagggaaagaagcgaagcagatattagaacagtatgggatcactttatcttctgtgaatattatcattccatttgcaaatgcaaagaccaaaagtaaatttgaaaccatgctgggcagggcaaagtgtctgatcagccatgcacacgaggcggggtgccgcaatgtactgcttatgccttctgtttatacggtagatgcggatgttacgagagaagacgcattccataatatggttaacggcttaaaagcctgcgtggattacggtgaagaaatgggaatttcaatcagcacggagacactggaaagcattgcggtgccatactgcagctgcggtgaaatggaacgcatctttcaagcggtaaggaagctgaaatatacacatgacacaggaaatccattaactgcattggagaacccggcagaagtatatgagatattcaaagacaggacagtatcggttcactttaaggattttgcgtatagtacggcagaagacgggattctttgcaacgatgggaaaaaagttgtcagtgttccgtttggcgagggggctgtagatttcaggaaacattatgatatgctgctccgggatggatacaaagggttcataacaatagaaggaagcgttccggcagataattccctggatggcgcagtaaaatctctgcaatattttaaggatatggagagagaggaaagagagaaaatatggggaggcaaaccggaatgagaaaaaatctgagatacggcatggtcggcggtggaccaggggcatttataggagacgcacaccggagggcaatcagcgtagacgatacggcgaggcttgtggcgggctgtttctcaagggatcctgagaaatcgagagttcatgggaatgcattggggctggacacagagcgctgctacgagagctataaggaaatggctttggcggaaggaaaaagaaaagatgggattgactttgtggttgtagttacgcccaatgccacccactatgaggtgtgtaaagcatttttagaagctgggattcatgtggcatgtgataagcctcttgcaacagacagcagccaggcggaagagttaaagcggattgccgatgaaaagggactgctctttatggttacttatacctatatgggacacgtgaccgcaaaatatgtgcgtgacttagtaaaaaacggagaaataggcacggttcgcactatcatggcagaatatcctcagggctggctatacaatgaaaaggattggggaggaaaacagggcgagtggcgctgtgatccgaaacagtcaggcagggtgaactgtctgggagacctgggaacccatgtagagaatgcggttgcaatgatgaccgggttaaaaataagacgggtgctggcaaaaatggatattgtcgttccgggaagaaagctggatgacaatgaccaggttctggtagagtatgaaggcggggcaacaggaatcaactggacttcccagtttgctataggatgtgataatagtctgcgaatcagaatctatggttcaaaaggcaccattctatggttccaggaggatccggaagaagtaactttgattaaagaggatggaatcccgcgcctggtgaaaagaagttaccctgccattactccggaagcagccagatacggacgtcttccggccggacataccgaaggctggctggaagcgatgggcaatctgtatgacagcttcggggaatgcgtggcagcgaaaaggaacggaacctttacagaggaaatgattgattatccgacaattggatatggcattcagggactgaagtatgtagaggcatgccttaagagccaggaaaatggaaatgtatgggttgagctatagagaagaagggagaaagagacgatgtcaagaccagtaacacttttcacgggacagtgggcagacctgccattggaggaaatgtgcagtactgcttctaaaatgggatatgaggggttggagattgcaacatggggacagctgaatgtaagaaaagcggctgagagtaaagaatatgtaaaagaaatcttgggtgtgctgcagaaatacaacttaggctgttgggcaatcggcgcccatctgaccgggcagtgtgtcggagatgccttaacatacgcctacgatccaaggttggatgggttcgcaccatccgaactggcaggaaagccagaggaaattcagaagtgggctgttgaagagatgaaatatacagcaaaagcagccaggaatatgggggtagaggtagtaacgtgctttatgggatcaccaatttggaaaatgtggtattctttccctcagacgacggaagagcaggtggaagaagcatatcagacgatgaaaagactgtggactccgattttggatgtattcgatgaattcaaagttaagctggcgctggaagtacatcctacggaaattgcatatgattactggagtacaaagagacttctggaaatatttgagtaccgccccacaataggaattaattttgacccaagccatctgatttggcagggagtagacccggcagtattcttatacgattttgcggatcgtgtataccatgtccacataaaagacgcaaaggtgaacctaaatggaagaaatggaatcctaggctcgcatattacttttggagaccagcggagaggatggaactttgtttcaccagggcatggggacgttgactttgataatattatccgggttctcaatcagaaaaattacaaggggccattgtcgatagaatgggaggacagtggcatggaacgggtattcgggggaaccgaggcctgtgcatttacaaagaaaattaatttttcaccatccgatgtagctttcgatgatgctctgaaaaatgattaaatatgaaatgtttaaaggaagcagggggaacttgcttcctttttccatttttagaatagtatacgtattggagcaatatattaaaataaaaacgaagaatcaaagaaggggcaaagaacaataaaaaattgaatttaccgataaaagatgttaggatagtgtagacgataaatggaatgccggttgcgtataccggtatacaatggaggaatattatggattttgcaaaaatgatagatcatacgattttaaaaccggatgccactagggaggatgttaaaaagctctgtgacgaggccgcagcatacggatttcattccgtatgcgtaaattcaagctttgtgtactattgcgcacagctgttaaaagatacggatgtaaaggtatgtaccgtagtaggctttcccctgggcgcgatgtctacagacggaaaagtgggcgagacgctgacagcggtatatgacggggcggaggaaatcgatatggtgattcatgtcggtatgataaagagcgggaactggcagtatgtgaaggacgatatagccgctgttgttgaggctgctgcagggcgtgccattgttaaggtgatcctggaaacatgccttctgactgacgaggaaaagataaaggcatgccagatctgcaaagaggccggagccgattttgtaaaaacatctacgggattctcaaaaggaggtgctactgcggcggatgttgctttgatgcggcggacagtggggccggttatgggcgtgaaggcttcgggtgggatcaggacagcagagaaagccagagaaatggccgaggcaggggcagacaggcttggaaccagctccggtattgccattgtagaaggcaattaagatgtggaagggaatcattgcggcggttattctggttttcctgttgtgtctggctgaaggaagacgggaactgcgctttttcaaaattacaagatataccctgaaggtacctgcatttaaaaaactggacagtgagaaaaagatcattttattggcagatcttcataataaatcctacggagaacataacagcaggctgttggatgcaatacggaaagaaaagccggatctgatcctgatagcgggggatatgcttgtggggaaagacatcgcctcttatcaggaagccctggattttgttacccggctgcctgcaatatgtccggtatattatggccctggcaaccatgagcagaggctgaaagaatacccggaaaagtatgaaaagagcgtatacaaaaagttcaaagaaggactggcactctccggtgtccattatctggagaaccagacagcggacataaaactggacaggctgcctatccgggtgaacgggcttgaactgccgatgctcacttatgagaaattcaaaaaacaccaagtggacgcagcagatatcagacaatgcattggaagggcggaacgggacaaatatcagattcttctggcgcataatcctgtttattatcctgcatacagggagtggggggcggatctgacggtatcggggcatcttcatgggggaatcgtgcgcattcccgggcttgggggtgtgattacccctcaggcggcgctatttccaaagtattccggggagatgaccgtggaaggcagccaggcgattgccgtaagcaagggacttggaacccacacgatcaatctgcggttctgcaattatgcggaagtggttgcaatcagcctgcttccatacagggaaacgaaataaacttgtgtattttgtgcatttcccttataataaaatgcagtgtgaatatctgcagcagggagcgtaagtatgggaataccagtaaagctggaagtattcgaaggcccgctggaccttctgcttcatttaatagataagaataaaatagatatatacgatataccgattgtagagataacgaatcagtatatggaatacatccggaacatgcagaaggaagacctcaatgtaatgagcgaattccttgtaatggcagcaacacttctggatattaagtgcaaaatgctgcttccaaaggaagtgaatgaggaaggggaggaggaagatccccgtgccgaactggtggaacagcttcttcaatataagatgtacaagtatatggcctatgaactgaaggaccggcagctggatgcggaacagatcctttataaagttcccacaattccggaggaagtgatgggatatgtggagcctgtagatttagaccttcttctgggtgatcttacgctgaaaaagctgcaccagattttcaaagatgtcatgaagcggcaggacgataagatagacccggtgagaagcaagttcggcaggatcgagaaagaggaagttcctcttcccgttaagctgtcctatgtggaagaatacgccaggtcacacaggaggttcagtttccggcagcttctggaagcgcagaagagcaagatgcatattgtggtaacattcctggcagttttggaattgatgaagctgggaaccattcgggtagaacaggaggagacatgcggggatattatgattgactcgctgatttgaaagggatggaagaagatatggagatagaaaaactacagggcattattgaagccatcctctttacgatgggggagtcggtggaattgggcaaaattgcagcggtgatagaacacgacgagaatacgacgagaaagatcatacataacatgatggaccgttatgaggaagaaaacaggggaatccggattatagaactggaagattcattccagatgtgtacgaaaaaagagacctacgaatatctgatcaggatcgcaaaacagcccaaacggtatgtactgacggaggttctgctggagacgctgtccattgtcgcatataaacagcccgtcaccaagctagagattgaaaaaataaggggagtgaagtcggatcatgcggtgaataagctggtggagttcggacttgttgaggaagttggacgcatggatgcacccggaaggccgcttttgtttggaaccacggaggaattcctgcggaggttcagcgtccagtcgctggatgaacttcctacaattaatccggagcaggtggaacattttaaagaggaagcggaagatgaggctcagctgaagctggatatataggaatcgggagaaaacaggttattatgcacggcatatgggccgtacatagtaacgaaaatagttctatcggcgccatgacctacataaatactaataacatagtatgttatggagtgcctggacatgataaaaaggaaaagacaggacggcaaagctgtccataagataaggaaacgaatcacagtgtttattttaatctgctgtatggttttcgcgggaaccgggggcagtacagttatggtggttcgcgcagagtcggaagagccggataatttatacgcccagtcagcagttttgatggatgcagacagcgggcgtattttattttcaaaaaatggacagcaggagaaggcaatggccagcacaacaaagatcatgacctgcatactggctctggaatacggaaaactggacagtgaaatgacagtgagctcatatgccgcatcccagccaaaggtgcatcttggggcatataatggggaaatattctatctcagggatctgctgtattcgctcatgctggaatctcacaacgatgcggcagtgatcattgccgagaacatcggaggcagtgtggaggggtttgcggacatgatgaatgccaaagccaaagagctgggctgcggtaatacatattttattactccaaacggactggatgccgcggacgaaaacggcagccatcacactacagcggaggatctggcgaggatcatgaagtattgcatcatggattcgccgcagaaggagatgttcctggagatcacccggacaccgtcctaccagtttaccgactgttccggaaaatccacgtattcctgtacaaatcataatgcatttctgcagatgatggacggcgcgctgtcggggaaaacaggattcacgggagatgcgggctactgttatgtgggggcacttagaagggatgaccggacctttatcgtggccctgcttgcatgcgggtggcctaacaataaaagctacaagtgggcggacacaaaggctctgatgaattatgcgctggataactatgagtaccgggacatctggcaggaaatagacgcggggacagtgagggttaaaaatgggatcgataaggagcatccgttccaaactgagacagaagttcccctggaagttgtaggggcagatcctaaatggaggcttcttcttaaaaccgacgaacaggtagagatgagctgggagaaggaagagatactggatgcccctgtagtaaaaggccagaaggccggcaaggttgtatatactttaaacggagaaaaattaagatcttatgatataacaacggtttcaggagtacaggaaaaaaactttaagtggtatataaaaacagtttttggtatgtatatgttaaaaaacatcaatttaaatgattaattttaccactggataataggcggtacttatgttagtatggatgaagataaaaaaagacaattaatttgataaaatataaggagatgtaactatgaaaaattatgaaaagtacgaaaaaatgtatttcatgccgcctgagccatgctatgactgggtaaaaaaggactcgattacggaaccgcctgcatggtgcagcgtggatttgagagacgggaaccaggcgttgatcgaacccatgggcctggatgagaaaatcgaattttttcaacttttattagacgtaggattcaaggaaattgaggttggttttccagccgcatcggaaacagaataccagtttctccggacaattattgagcagaacatgataccggatgatgtgacgattcaggtgctgacacaggcgagagaacatattattaaaagaacttttgaagcggttaagggtgctcctcatgctgtaatacatgtatacaattccacttccgtggcacagagagaacaagtattcaaaaaagacaaagaagaagttaaaaaaattgcggtcgacggagccaagttattaaagaaactggcaaaagagacagaaggcaattttactttcgaatatagtcctgaaagttttccgggaacagaagttgactatgcgctggatgtgtgcaatgcggttctggatgtatggaagcccacgaaaaagacgaaagcaatcatcaatctcccgacaacagtggagaacgctatgcctcatgtttttgcaagccaggtagaatatttcgataagcatctgttataccgtgaaaacgtgattctttcccttcatccgcacaacgacagaggttcaggcgtgagcgatgccgagctgggaattctggccggagcagaccgcatcgagggaaccttatttggaaacggagagagaacaggcaatgtagatatcataacccttgcaatgaatatgttttcacatggggtagatccaaaacttgatttcacgaatatgagtgacatctgcgaaatatacgagcgcctcacaagaatgaaggtttcaccacgccagccatatgcaggagaactggtatttactgcattctccggatcccaccaggatgccattgcaaagggaatgtcatggagagaagaaaaacagtgtgataaatgggatgtgccttaccttccgatcgacccgaaggatgtgggcagaagatacgactcagacgtaatccgcatcaacagccagtccggcaagggcggcgtgaactatatcctgaagcagagcttcggaatcagccttccagataaaatgaaagaagaagtaggctatctggtaaaagacgtttcagacaaagcgcataaagagctggatcctgactgggtatatcacatattcgaagacaattacatcaatgcaaaatccatctttacagtggatgaatgccattttaaacaggaagacggtattgtggcagacgctgtcatccaccattcaggcagcaaccgccggatcaccggcgtaggaaatggccgtctggatgcagtaagcaatgccattaagcactattttgacatcagctacgaacttgcattttacgaagaacattccctgacaaaaggctcctcctcaaaagcggttgcctatgtaggtgtaatctgcaacaaaaagaaatattggggcgtaggaatagatgcagatattattaaggcatctgtggaagcacttgtcgttgcagttaacaagatcgaagaaatcaagagcagcgaatccagcaaagatgagagattattagaaatcaccaactacatttacgcaaattataaagacgtaacactggatgacttatcagagaaattctttctctccaagccatacctctccaaatacatcaaagaaaaatccggaatgacatttggagacatcctaaaaaaggtaagaatgaaaaaagcacgttccatgcttaaaagcagcaatataaccgtagaaagtatcgcggaatccgtgggataccaaaacgtagaacatttcaaccgcgtattcaaaaaaatgtacaacatgacacccgtgcaatttcgaaatcggaagtagggaatgagcttgggaatgagcggacggacgccgctggaaccggacatagggatggctggggacggaagcagactgtaagctggagtaaaggaaaaaagaaggaaacccggggcaacctggggccagcacgagaagccccgatggcttctcgcgctggccccaggttgccccgggtttccttcttttttcctttactccacctaacagcctgcaagacgcctccagccatccctatgtccggttccagcggctggcgcatcaaggcggaaaagcccactttcgggagaatcctggcgggggaggtggatcttgactggctgcgcgtatatttaaatgcataggtatttttattttatccagtcccatacgcagcccccgtcagaatcccaaactgcatattcctacctgatccttcatttcttccgtccggatgaagcccagcctgtgcggaatggggagagggatgctgcggaaaaaagagactgcaaatacatgcagcctcaatttcgccattattgttcttccgccagtttatccagtttcccgctcattgcccagagtattgctccaagtatgattacgacacctgcaacgactccatatccaatctggaagggaactgttttcagatatgcgtacagtgccgggtagatcgttgttgcgaagaatactgctattggccacaggccgagcagaagtcccagtacttttgccggggcaaacattgtgatgaaagagttgccgagcggggagaataccatctcaccaattgacatcagcagggatacgaatacgatccagatcagtgcagcctggcctccgcctctgattacatcagctaataccatgattacgaatgagcatcctactaagatcattcccagtgctgttttcttgaacatactcatatcaccttgcggacgttttgcgagttttgcccagacgatcgcgagcaccggtccaaggacgatacatgtcagggcgttcagtgagtcaaagtatgaagtcggaacctgccagcttccgatgtaccagtttgcatggttcaggaagtctgacccctcgccccatccgaagtaaaagtaagcaggcatgtatgccatataccatacgacccagaatacaatagaaaaaacggttacaaggatgatggccaggattctttttttgtcaccctttgtaagaggtttgctggattcttcttttttcttgctgttgtcaatgaattttctctgatcatgcttgaatggctttttaccggcatcaccgagagacttctggttgagtgcgaaccagagtgcatcgatgaacagaaaaatggcgcacagcaggaaaacagtattgaaagttgttttaacgcctacaagccctgtgatcggcaggatggcgataaaggttgtcccgatgaaggaaccgacatttacaaatgaatactgaatagaaaatgcattgttcaaatcatccttgtcttcaaataacagaccatttacgcctgagaggtttcccttaaataacccggtacctagagcgacaagtatgatcatgatccagacaagagtcatggaacgggcctgccaggtacataggtatccaagtcccatgagggtcattccggcaatgacacagattcttgggctgagccaatagtctgcaatgtatcctcctaggataggcgtgatataggtggctgccacaaagaaggcggaagttgcagttgcctgggcatctgttaagccaagaccgcctcccgctgcattcgtggcgatccagattgccagtaagtacttaacggtgtagaacgcgcagcgttcgaatgtgaaacctaaggcgcatacataaaagccaaatggtttcttcttttttgctgtttccataataaaaaccctccaattagtttttaaagtgagcactgtaacagtgcaaattgatgagaatacataccagatatcctctgttgtctagaaaaacctcctcctttgttataattttactccgaggagattgtaccatagtttgaactatagtacaaataaaactttatgcttaattaataaatcttcactggaattttataagtattccttagtattgtgccataaacatattaaattgcattacttcgcgaaaaacaacataaagttcttgacaaaccttccaaattatgacattataataatagtaatcattattaatattgagaggaaagaaaggagctgcgatgcatcagtatacaaaaatcaggataccaattgatcaggataacccctccataatgaggcaggaagatctgtgtataaaatgtggtcagtgcaggcgggtgtgtgaggaggagattggggtaggaaaactttattcactggagagcactggagataaggcgatctgcatacattgcggacaatgtgcaaatgtctgtccggcaggttcaatcacagaagtgtacgagtatcgggaaatcaggaaggcaataaaagatcctgataaggttgttatattcagtacatcaccatcagtcagggtcggacttggggaagagttcggaatgctgcccggaagttttgtggaaggagggatggtggctgcactcagggcactcggtgcggattatgtgctggatacgaattttgcagcggatctgaccattatggaggaagcctcagaactggtggagagaattacaggcagtaaaggggtactgccccagtttacaagctgctgcccgggatgggttaagtttgttgagacattttatcccgaggtgctcccgcatatctccacgtcaaaaagccctattggaatgcaggggcctacgataaagacctattttgcggagcagaggggaattgatccagataaaatcgtaaatgttgccgttactccctgtactgcgaagaaatttgaaatacgccgggaggaaatgcgggattctgccgactattattccaacgaagacctccgtgacatggatcatgtcatcacaacgcgtgaactggctcgctggatgcgggaggatggcttagatctcagcagcgtagggacaagtgaatacgatgaattaatgggggaggcttccggtgccggtgtcatattcgggaacactggcggagtcatggaagcagcggcccgcacggcgtattatcttgtgagcgggacaaatcctccggaagatttcctgaatctcgagcccgtgaggggaatggacggtgtgagagaagcggatgtggagatcagcggtattcatttgaagctggcagtgatccatggtacggagaacgcgcgaagatttctggaacagtggaaacatggggacgtccattatgattttgttgaagtaatggcatgccgcggcggctgtatcggcgggggaggccagccaaagacggagattccaatgagcgatgaaatcagaaacgcacggatttcttcgctatatgaaagggatgcacacatgaagctgaggctaagccatgaaaatcccgaaatcactaaactttacagagaattttataagtctccgttaagtggtttggcagagaagatgcttcatacgacttatagagacagatctaatgatctagggccggagggaaaaaagaatccggacaaacagaaatcccaggagctggaaaaagtggtattatatatagaagaaacagaaaacataattgagaaggagacaggtattatgaaaaaatggaaatgcagtgtatgcggatatattcatgagggagaaaatccgccaaaagagtgtccgatctgtaaggtaccggcagacaggtttcaggaactgaaagaggaagcgccggcaaaagcaccgaaaccagctggtgcagcaggaaagccggcgccgggctctaagacagaaaaaaatctgatggaagcttttgccggggaatctatggcgagaaataagtatacatattgggcggatgtggcgaaggaaaacggactggaacagatggcagccattttcctggagacagcggagcaggagcgtgagcatgcaaagatgtggttccgtgcattccatgggatcaacgatgtggagcagaatctggtggatgcggctgcaggcgagaacgaagagtggacccagatgtacaaacggatggcagaggaagctaaagcggaggggtacgatgagatagcggctaaatttgagcttgtagcgaaggtcgaagcacagcatgaaaagcggtatctgcgtcttctggagaactataaggcgaataagacatttgccggggaagcgccgcttgggtggaagtgcagaaactgcggttatatacacgaaggggccgacgcaccggaagtatgcccggtctgccagtatccaaaggcttactttgaacgtcaggcacacaattactagtacatcgaaaataagtaacttgctgttatgctgaggaggcggaaagcagcagggaagctgaatagaatgtaagagcccggcaggactcccggggaggcgtaatcaggaaataattgatctacgcgtctcacgggagctgttttatgtttaccggacagtgcatcgtaaaatgattgtcaagtaaaataatcataaaattgtaaacagcagacttgtattgcatgccctgagattttacatttttatacaagatattgtggttttggcgttgatcggaagaaaagtatgtgaaaaaaatatcaaatcttggattttatgaattgaaattttgggttaagtagtatatactagaataggcagaaattttggttttatttcaaacaaattaaataatatggagggctagattatgagctacaacgctacagaaaactcagcgagcagacgaattgccatgctgcttgatgagggaagctttgttgagatcggcggtgctgttacagcaagaagcactgatttcaacttgcaggcaaaagatactccggctgacggtgtgatcaccggttacggggtaattgacggtaatcttgtttatgtgtacagccaggacgctacagttttaaagggcgcgatcggtgagatgcacgcgaagaaaatcgccaatatttatgacatggcaatgaaaatgggagcaccagttatcgggctggttgactgtgcaggactgagacttcaggaggctacagatgcgctggaagctttcggaagtttatacttcaaacagtccatggcttcaggcgtgattccacagataactgctgtctttggaatgtgtggcggcggcttagcagttgtgcctgggctgacagattttacttttatggagagtaaagaaggaaagctgtttgtaaattcaccaaatgctctggaaggcaacattgattctaagtgtgatacttcctcagcagaatatcagagcaaacatgcaggtctggtagacgtgatcggtaatgaaaccgatattctgggacagatccgcgcgttaatctgtatgattcctgccaataatgaagacgatctttcttattcagaatgtacggatgaccttaaccgtctctgtgctgacattgcgaatgccgcagaagatacaggcattgcactggcagaactttctgataatcatattttctttgagacaaagaaagaatacgcaaaagatatggtaaccggatttatccgtctgaacggcatgacagtaggcgctgttgcaaaccgttctaaagtatacgacgccgaaggcaatgtggcggaggcattcgataaagccctttctgtagatggctgcaaaaaagcgattgatttcgtgaatttctgcgatgcattttctattccggttctcacactgaccaatgttacaggatttgctgcaacgatggaatcagagaagaacatggcaagagcagttgcaagactcacttatacatttgccaatgcaacagttccaaaagtaaatgttattgttggaaaagcttatggcagcgcatatgttgctatgaacagtaaatctatcggggcagatatggtctatgcatggcccgaagcagagatcggtatgatggactccacactggcagctaagattatgtatgctgatgcagacgctgatattctcaaagaaaaggcggcagaatataaggcgttgcagtcaagcccgctgtcagctgcaagaagaggatatgtggatgcgatgatcgaaccggcagagaccagaaaatatataatcggagcattcgaaatgctgttcacaaaaagagaggaccatccggataagaaacacggtacggtttagtgaggtgaggcaaagtgaagaaaaaaatcagtttattagctctagtctttctcctcatcttcagttttacaggatgcggcagtaaagcaaaagacgcagcagaatatgaccaggctacattgcaaagctacgctgacacaattgtacagagtttcagcagcatgacagatgatgatcttaacagattcgaggatatgtcagatttggaactgaatctgactttgatgcagtcggggattccggttgaaggagataacttcctgactattattgaggcatggaaggctggcattaatgagtgtggcgctgttaccagtgttgacagttatgagctggcaaccacgaacagtggtgcaacactaacggcaaaagcagtatttgaagacagaaaaggtgaaatttcatttacctttgatgaaaagatgaacatggaaagcctgacggtcagtgcagattattcgacaggcgagatactggaaaaggcagggctcaatacagtccttggaatgggtactgtatttgttgtattaattttcatttcttttataatttctttatttaagtttatacctgctattgaaaagaaattcagtaaaaaagcaaacgtagccccggccgcaccggctgcagcgccaattgcagcaacgccggcagtaccgcaggccgcggatcatgatggagagcttgccgcagttatagcagcagcgattgcagcggctgaaggcacttctacggatggatttatagtccgttcaatcaagagaagaaagtcaaataaatggagttaatcaggaggatataagagatgaagaattatacaattacagtaaatggcaatgtatatgatgtaaccgtagaagaaaagggcgcaggcgcggcaccagcagcacctgtagcagcaccagctgcagcaccgaaggcggctccggcgcctgcagcagcggctccgcaggcagcgggcggtatcgaggttaaggcgggagcagccggaaaagtatttaaaatcgaagcaaacgtaggacagagtgttcaggccggagatgcagtcgttattatcgaagccatgaagatggaaatccctgtagtagccccagaggcaggaacagttgctagcattaatgtagcagtaggcgatgccgttgaatcaggagcagtcttagctacattaaactagttcaccaggaggtttgacaaatggaatatatttcaaatacgttgggaaacctcgtgcagcagacagcatttatgaatctgaccgttggaaatctgattatgatcgttgttgcatgtgttttcctatatttagcaatcaggcacggctttgagccgctgctgcttgttccaatcgccttcggtatgttgttggttaatatctatcctgatattatgctgcatgctgaggatgctgctaacgggacaggcggacttctctattatttttatttgctcgatgaatgggcgatcttaccatctctgatattcctcggcgttggtgcaatgacagatttcggtccgttgattgccaatccaaagagtttccttcttggtgcagcagcacagttcggtatctttgcggcttacctgggggctatggcattgggcttttcagacaaagcagctgccgccatctcaattatcggaggagcagacggaccgacatccatcttcctcgcgggtaaactgtcacagacggcaattatgggaccaatagctgttgcagcatattcatacatgtcgcttgtgccgatcattcagccgccgattatgaagctgctgacaacagaaaaagagcgtaagattaagatggaacagctgagacctgtatccaaactggaaagaatcctttttccaatcatcgttacgattgtagtctgcgtaattcttccgacaacagctcctctggttggtatgttaatgctgggtaacctgtttaaggaatctggtgtggttagacagttaacagaaaccgcttcaaatgcactgatgtatatcgtcgttatcttactgggtacgtctgtcggcgctacaacgagcgcagaggcattcttgaactgggatacaatcaaaatcgttatcctcggtttaattgcatttgcatttggtacggctgccggcgtattgttcggtaagctgatgtgcgtggcaacgggtggcaaggtgaacccattgattggatcggcgggtgtatctgcggtacctatggcggccagagtttcacagaaagtcggagcagaggcggatcctacaaacttcctgctgatgcacgcaatgggtccgaacgtggcaggtgttatcggtactgcggtagcagccggaacctttatggctatcttcggcgttaaataataatggaggacaaataaatggcagagattgaaaagaaaccagttaaaataacagaaacagtcctgcgtgatgcgcatcagtccctgattgccacaagaatgacaacagagcagatgctgcctatcgtagataaaatggacaaagtaggatatcatgcagtagagtgctggggtggtgctacatttgacgcatctttacgtttcctgcatgaagatccatgggacaggttaagaaagttccgcgacggatttaaaaacacaaagctgcagatgctgttccgtggacagaatattctgggatatcgtccttatgctgatgatgtggtagaatacttcgtacagaaatcagtagctaatggtatcgatattatccgaatatttgactgtatgaatgatatccgcaacctccagacagcagttacagcatctaacaaagaaaaggcgcatgctcaggtagcgatgtcttatactctgggggatgcctatacactggaatactggatggatctggcaaagagaattgaggatatgggcgcaaattctatctgcgtaaaggatatggcaggacttctctgcccatatcaggcaacagagcttgttacagcgttgaaagaagctgttgatattccgatcgagatgcatactcattatacatcaggcgtgggtgcaatgacatatctgaaatcagtagaggcaggagccgacattattgataccgcaatgtcaccgtttgcactgggaacatcacagccggcgactgaggttatggtcgagacatttaagggtacaccttacgatacagggctggatcagaatctgcttgctgaaatcgcagattatttcagaccgatcagagatgaagctcttgagaacggccttctgaatccgaagaacatgggcgttaatatcaagacccttctctaccaggtaccgggtggtatgctttcaaacctgacttcacagttaaaagagcagggcgcagaggacaagttctacgaagtacttgaagaagtaccgcgtgttcgtaaagaccttggtgaacccccgcttgttacaccatcctctcagatcgttggtacccaggccgtatttaacgttctgatgggagaacgctacaaaatggcaacaaaagaaacaaaagacgtattatcaggaaaatacggtgcaacagtaaaaccgttcaatcctgaagtacagaaaaaagtaatcggtgagaatgcagaggttattacctgccgtcctgccgatctgattccgaacgagttggatacactgcgtaaagaatgcgaacagtggatccagcaggatgaggacgtgctgacctatgcactgttcccacaggtagcagtggacttctttaagtatagagaggcgcagcagacaaaaatagacgcaaaagtagcggatacacaggacggagcttatccggtatagtggatggtatgggggcgcaaagtgaaaggtgcatctgctcccagccggggctgtgtatgccatttcagaatccgacccgcttgctaagaatccgtaagagaaaaaacagggaacatggaggtacttgccgcagttggcccaaaatcttgatgattttgggccaactgcggcaacagaatttgcctggtaaggcaaattctgccccccatgttccctgttttttctctaacggattctaacacgcgctctacggattcctgaaatggcatacacagccccgctgggaacagatgcgcctttcacttagctggtgtgccccaggcgggagaagaaccggcccgaatggtaagcggacgggagttgcagatgttgaaagagagccgatagagtatgctctgaagttctggtttgccttagaattccataagcgtataaatagtagttgaaacatcataattttttctatcaataggctataacacgatccgtgcagtcaacttaatccgccgcccccgttaattcctccacgggatgaaatgtaccttccgttttgatgcaccaagcctgtcgggagatggggcgggaacttccctgtgcttttatggaggcatagggaagttcccgccccatctcccgacaggcgtccccaaaaaagtattttcaccccaaaaatttgtatagatttttgtttggtggtataatatgttttatgaatgtttaaggaggtttttcatgaaggtttcggaaagagttgacagtctccgacgtttgatggaggagaaagggattgatgcatatgtggtgccgactgcggattaccatcagagcgagtatgttggggaacattttaaggcaagggcttttatgaccgggtttaccgggtcggcgggaactgctgtgtttacaaaggatgaagcgggcttatggaccgatggcaggtattttatacaggcagaacagcagctggaagggaccggcgtggagctgcgcaggatgggggaaccgggtgttcccactgtagcggactatttgaaggctgttctcccggagaatggtgtgattgggtttgacggtcgtaccgtcggcgtggatgaaggacaagtgtatgccgatattgctgcggacaaaggcgggggtgtggtttatgactgtgaccttgtagatactgtctgggaggacaggccgcctctttctgaaaaagcggcatttatactggatattaagtatgcgggagagacagctgcctctaagcttgagcgggtgagaggcgcaatgaaagaggccgggtccaatgtccatattattaccagcctggatgatatcggttggctgctcaatgtgagaggggaagatgtggactattttccgcttctgctttcttatgcgatcataaagatggattcggtggagctttatgcggatgagagaaagttcaatgatgagataaaggcggaatttaccggaaatggagtttgcatacatgcatacaatgaagtttatgaggctgtaaaaaggcttggcgacggtgatgtgatactgttggacccaaaacggatgaactttgcactttttcataatattcctaagggggtaaagactgtaaagcaggagaatcctacaattcttatgaaagccgtcaaaaatgatacggaagttaagaatatcagaaatgcccacattaaagatggcgtggcgcatacgaagtttatgtactggctgaaaaagaatatcggtaagcaggagataaccgagctgagtgcctccgataaactccaagagttccgtgcgcagcaggaaggatttttgtggccgagctttgaaccaatctgtgcttacaaagaacatggtgcaattgtacactatacctcatcgccagagacaaatgttgaactgaaagagggtggcctgtttttgacagacacgggcggacattattatgaaggatctacggatatcacgaggacagtggcgctgggggaggtgagccaggttgagaaggatcattttactacagttgccgttagcatgctaaatctagccgatgcaagattcttgtatggctgcagtggaatgaatctggactatgtagcacgggaaccgttctggagacagaatctgaattttaatcatggaaccggtcatggtgttggatatctcgggaatatccatgagccgccggcaggcttccgctggcagttccgtccaaatgagatccagcctttcgaggagaatatgattataacggatgaaccgggaatctatattgaaggatcccatggcatccgtacggagaatgagcttttggtgcgcaggggcgagaagaatgagtatggtcagtttatgtatttcgaaccggtcacatttgtgccgatcgatctggacgctgtaaacccggcgctcatgacggaaaaggaaaaaacgctgctcaatgattatcataagaaggtttatgagctgatagcccctcatttgacagaggaagagcaggattggttaaaagaatatacgagagcgatttaacagcaaaagccctgcatggaagtaaaaactgcctgtgcggggctgtgttgttacaatgaactcctccttgcaatcaaaatcccagtattgtataatcagaatgttaaattataaaacaagtatattctgcccaaattgaatgagaaaatgagaagaggaactgccgtgagtgaaaataagttaagcacaaatgagaatagtacgaatgaactgctgcttagaatagaagaaaagtataaacgcctcagcaaaggacagaaaaggctggcggaatatgtatgccagaattacgataaagccgtctttctgactgctgcaaaactgggggatattgtaggcgtgagtgagtccacggttgtccgttttgcaacgcagctgggatataaggggtatccgggctttcagaaagccctggaggagctggtgcgcaacaagctgaattctatccagaggatggaagtgacctacggaagaatcagccagtctgagattcttgctactgtgctgcagtcggatatagagaagatcaagctgacgcttgcggggatagaccagaaggcgtttgaacttgccattgatacgattctgaaagcaaagaagatttatgtgatcgggatacggagctgtgctcctctggctgcatttttgacgttttatctgaatttgatctgtgacaatgtgacggcagtcaatacgaacagttccagtgagattttcgagcagctgatccggatcgatcaaaatgatgtgatcataggaatcagtttcccacggtattcgatgcgtacattaaaggcgcttgaatttgcgagtaaccgcaaggcgaaggttatcacgctgacggacagtattcattcccccatgaatctctattcttcctgcaatctgatcgccaggagcgacatggcctccatcgtggattcgctggttgcaccgctgagcgttgtgaatgcgctcgtggttgcgctctgcatgaaaaagcagaaagaagtagttgccactctcgagacgctggaaaaaatatgggacgagtatcaggtatacagtggtgatgagctgaaccatgtcagcagttctatgccgggtggaaaggacacggaaggtagtggggatgagtaaagtactgataatcgggggcggcgcggcaggaatgatggcgggcatatttacggccggaaacggacacgaggtccgcatatatgaaaaaaacgagaaattggggaaaaagctttttattacaggaaagggcagatgcaacttgacgaatgccggagagatagaaactcttttttcttcggttcgaagcaatcctaagtttttatacagtggattttacagttttacgaatgagcaggcaatcgagttttttgaaaaactcggggtgagaacaaaagtggagcgtgggaaccgggtatttccggaatcggaccattcttcggacgtgatttctgcgatgagcagagagttgaagcggctgggagccgggatttatctgcacgcggaggtgaaacaggtactggctgatgagggacatttcacgggtatccgccttgccgatggtaagactgtatcggcagatgcgtgtatcatagcgacgggcgggatctcctatccttcgacgggatctaccggggatggataccggtttgcgcgggaagcggggcacaaggtaactgcactctacccgtctcttgtaccaatggaagtaaaggaggcatttatccctgcacttcagggattgtcacttcggaatgttaatgccgtgatttatgatgggaaaaagaaagtttatgaagaattcggcgaaatgctgtttactcattttggcgtgagcgggccggtcatcattagtgccagcagtgtgataggtaaacttctgggagagaggaaactccggctttccattgacctaaagccggcattgtctgcagagcagctggatcagcgtgtgctcagagattttgaagaaaacaggaataagcagtttaagaatgcagtagataagctgtttccggcaaaattaaagccggtcatgatcgacaggagcggcatcgatccggaaaaaaaggtcaacgagatcagccgggaagaaaggcgtcaatttgttgcgctgatcaaggactttgatatgacgctcacaggactgcgggggtacaatgaggcgattgtcacgaaaggcggcgttgatgtccggcagcttgatcctggaacgatggagtctaaactcgtaagcggactttattttatcggggaagtggttgatctggatgcactgaccggcgggtttaacctgcagatcgcatggtctaccgcctatctggcgggaaatgcggtacgttgacgaaaaaggaaggcatggggaggaaagaaagaatgggatataatgtggcaattgacgggccggcaggggcaggcaagagtacgattgcaaaacttgtagctaagaaaaaagggtatatctatgtggataccggagcgatgtacagggcacttgcactctgttttctggatgcaggcattgcacccggggagacacagcggatgatcagtgtgtgtgaggatgcagttgtaagtatcagatacgagaacggagtacagcaggtctatttaaatggaagaaacgtgacttccagaatcagggaagaagccgtcggcaacatggcctctgtgagttctgcagtcccacaggtgagagcgaaacttctcgagctgcagagggaattggctgagaaggaagacgtgattatggatggccgtgatatcggcacgaacattttgccccatgctgatgttaagatatatctgaccgcgagcgtagccacaagggcaaggagacggtatgatgagctccgggaaaagggagaagaatgcgattatgaagaaatagcccgtgatatccaggaacgggatgaaagagacatgaaccgggagacggcgccgctgaaaaaagcggaggatgctgtccttatcgacagttctgagatgacaatcgaggaagtggctgcagagattatacaatactgcagataacaggaaggagccgatttcttttatatttctgcaggaagtatatggaaaagaaaaacggaacacagacatatttggaaaaggagcagagaaaagatgaaaatagtacgggcgaaaacggccggattctgcttcggtgtgaagcgggccgtggaaacggtatacaaagagcttcaggaggaagcgggcagcggccctcggatttatacttacggtcctattatccacaatgacgaagtggttaaagatatggagaaaagaggggtgaaggtgctgcggacagaggcggaactggaatctttgacagagggaacagtcatcatacgctcccatggcgttccggagtatatttataaaaaaatggaagagcaggggcttacggtgagagacgcaacctgtccctttgtcaagaaaattcataatattgtgcaaagagagagcagggcgggcagctacattgtaattatcggtaatccggaacatcctgaagtgcagggaatcaggggctgggcgggagatcatgtgacagtggtgcagaacgaaaaggatgcgtccgactttgttccaaatccgggaatgaaggtctgcattgtggcgcagacgacatttaattacaataaatttcaagatttagttgaaattatctccgaaaagagttatgatgtaagtgttttaaatacaatctgcagtgcaacaaaggagcgtcagaatgaagcggggagtattgcagaagaggtggatgctatgatcgtgattggtgacaaacatagttccaacacccagaagttatttgaaatatgccagaaagcatgtaaagatacgtactatatacagacacttgacgatttggatttgaatcaattagggtcagtggaaacagtaggtattacagcaggggcatccacgcccaacaatataattgaggaggttcaaaataatgtcagaattatcttttgaacaaatgttagacgagtcatttaaaacaattcacaacggagaggtagttgagggtacggtcattgatgtaaagccagatgagattatcctgaatatcggatataaggcagacggtatcatttcaaagaatgaatattcaaacgaccagtcaattgaccttactactgtaatttcagtaggggatcctatgactgtaaaagttctcaaagtaaatgacggcgaaggacaggtattactgacttataagagacttgctgcagagaaggggaatgagaggctgcgcgaagctttcgagaacaaagaggttctgaaggctactgtaactcagattcttggcggtggattatgtgcaacagttgatgaagcacgtgtattcataccggcaagcctggtatctgattcttatgagaaggatttaagcaaatatgaaggccaggagattgagtttgtgatcagcgaattcaatccaaggagaaaccgcgtgattggtgatagaaggcagttactagtggcagagagggcagagaagcagaaagagctgtttgcgaagctgcgcgttggagatacaatcgaaggaacggttaagaatgtaacagattttggtgcatttattgatcttggtggagtagacggattgttacatatttccgagatgtcctggggaagagtagaaaatccgaagaaagtattccaggttggagatgttgtaaaggttttggttaaagatatcaatgatacaaaggttgcgctcagcctgaagttcccggagacgaatccgtgggcacatgcggcagaggattttgccgtaggtacggttatcaatggaagagtggcacgtatgacagactttggcgcttttgttgaacttgcgcctggagttgatgcacttcttcatgtttcccagatttccagggcacacgttgagaagccttccgatgttctttcgatcggacaggagattacagccaagatcgtagacctgaatgagactgataaaaagatcagcctgagtatgaaagcgctggagccggatgcacaggaagctgatgcaacagaagagtaagaataccatatgtgcatgcgcagtggtatttagagcaggtacggagatggtatacccgcagggcaccccgtaatacatgcccttcgggcgggtctgcagcctagctgcagaataatgtataagaaaaggataggggcttagaaagtctctatccttattgtataaggatttattgccgaaacaggtgtatggggtcaggatttcattgtaaaaacgggaatcctgatcccattgaagtttatgacatgtgttaaaaaaacgtcaaaatatatgcattttgtgtttttataggcggttatttattatatttactggattttgcatacaatttctagtacaatacaattattgcgaaaaaagaaaggaaggtagtaaagaatgggacttttaacttttaagggcggaatccatccaaatgatggtaaaagcctggcaaaagatcaggcaattgctgaagtactgcctaaaggcgacttggtatatccgctttcacagcatatcggtgcccctgcaagtccaatagttcagaagggggatcatgtgttaaaaggccagaagatcgctgaggccgggggatttgtgtcggcgccggtctattcatctgtatcgggcacagtcaaagggctggaaaagcatttcaatcctacgggaagcctggtcgattgtattgtgattgaaaacgacggagaatacgaggaagcggagcgcagcacggtgaaacctcttgaggagatgtcgggagaagagatcatcggcatgatcggagaggcaggaattgtcggtatgggcggggccggttttcctaccagagttaagctttcaccaaaagaaccggagaagattgattttattatagcaaactgtgcagaatgcgagccttacatcaccgcagactaccgcaggatgctggagaataccgaagaacttgtgagcggtatgagaatcgttctctccctgtttgataatgccagggggatctttggtgtagaagataacaaaaaggattgtatagaaaagcttagagaagcggtgaaagatgagccgcgaatggaagtgaaggtgcttcagacgaagtatccgcagggcgcggagcgccagctgatctacgcagtcacgaaacgagccatcaattcttctatgctgcctgcggatgcgggatgtattgtggataatgtggagacgctgattggcatacattatgcggttgccaaagggcgtcctctgacggaacgtgtagtgactgtgagcggggatgcggtaacgaatcctgggaattttctcgtacagctcggaacaaaccaacaggagcttgtggaagcggcgggcggtttcaagacagaaccgcagaagctgatttcaggcggcccgatgatgggattcgccatgatgacactggatactcccgtaactaagacgtcttcttctattcttgcatttacagaagatattgttgccaagtccaagacaacagcctgtattaactgtggacggtgtgtggaagtatgtccaagccggatcattccctccagactggcggattatgctgaacggtttgatgaagagacatttacagcgcagaacggactggaatgcgtggaatgtggttcttgcagctatgtttgtccggcaaagcgtccgctgaaacaatccatagggtcaatgcgtaagattgccctggcaaacagaaagaaaaaataacagagaggtgaataaaagtgaacgagaattataacatatcatcttcaccgcatatacgggctaaagtaaccagcggcaatattatgctgatggttgtcatagcgctgctgccggctacaatctttgggatttataatttcaggcatgaaaatgcatggctcctggtggtggtaactacagtatctgcggtgctggctgaatacatatatgagaagctgatgcataagccgattacgattaaagactggagcgcagttgttacaggactgctgctcgctctgaaccttccgccgacgcttccgctgtggatgggcgcgcttggatctgtatttgcaattatcgtggtgaaacagctgtttggaggattgggacagaacttcatgaacccggctttgggggcaaggtgtttcctgcttatatcctttaccgggcgcatgacttattttgtatatgacggggtgaccggggcgactcctcttgcggagctgaaagcaggggagacggtgaataccatgaatatgctgatcggaaatatccgcggcacaatcggtgagacttccgttctagcgatcatgctgggcgcaatgttcctgcttctgatcggggtgattgacctgagaattccgggtacatacatcgttacatttgtgatttttattaccatattcggcgggcatggctttgatccgcagtatattacggcgcatctgtgcggaggaggcctgatgctgggcgcctggttcatggctacagattatgtaacctcgcccattacaaagcgggggcagattgtatatggtatctgcctgggcctgctgaccgggctgttccggttgtttggaggctctgcagaaggggtatcttacgcgattatcatcagtaaccttttagtgcccctgattgaaaaggttactcttccaaaaccatttggtaaaggaggagaaaaataatgaataaaattgtcaagaacactttaatacttacagtgattacactggttgcaggcatactgctggggcttgtatatgaggtgacaaaagagccaatcgcaacggcccaggagaatgccaagcaggaagcgtacaagacggttcttgcagatgcggtttcttttgaagactatacggagtttgatgagagtgaggcagccgcagccctaaaagaaggtggttacgagagcgatgatattacagaagtggccgttgcattagacgagagcggtgcaaccatgggatatgtcattacggtaacttcacacgaaggctacggcggggatattaagctttctgtcggtattttaagtgatggaaccgtaaaaggtatcgaaacgcttacgatcactgagacggccggccttggaatgaaagcagcggaaccggaattcaaggatcagttcaaagataagcaggtagagaagttctcttatacaaagacaggagaagagggcgacgataagattgacgctttgagcggcgcaacgattacgaccaatgcggtgaccaatgcggttgactctgccctggtatattttcagagtgtgttaggaggtagtgtcaatgaataaaaatacagaaagactgtataatggtctggttaaagagaatcctaccttcgtattaatgctgggaatgtgtcccacgctggcggttacaacttcggctataaacgggattggcatgggcctttccacaactgtcgtgcttgtgttatccaatatgctgatatccatgctgcgtaagattatcccggattccgtcagaatgccggcattcattgttgttgtggcttcttttgtaacaatggttcagtttctgctggaaggttttgtcccaagtctgtatgattctctgggaatttacattcctctgattgttgttaactgtattattctgggaagagcggagagttacgcttcgaaaaatcctgtgcttccatccatatttgacgggatcggaatggggcttggctttactgtaggccttacggcgattgggattgtgagagagcttgtcggatccggaaagatttttgaccatcagattctgccagactcttatgagccgattactatctttattctggcaccgggtgctttcttcgttctggcactcctaacggcgcttcagaacaaggttaagaaaaaagcagcagctaagggagatccgatcgctgaaaagatcggatgcggttcgggatgtgccacatgcgggaagaaagaaacctgcggtggaagtatgtttatggatgtgcgcccggaaccgaaaaaagcaggaaagaatgggaatgaataggaggggaatgagatgaaagaattacttttaattgcagttggtgctgcatttgtgaataacgtcgtgctcagtcagtttctcggaatctgtccgttcctcggtgtttctaaaaacgtaaaaactgcaggcggcatgggcggcgctgttatctttgtcataactattgcgtcgtttgtcacaagcctgatctacaagttcattcttgtaccgacacattttgagtatttgcagacaattgtgtttatacttgttatcgcagcattagttcagtttgtagaaatgtttctgaaaaaggcaatgccgccgctgtataattcactgggcgtctatctgccgctgattacgacaaactgtgcggtgcttggtgttgcgctgacaaatgtgacgaagtcttacagcattctggaaggcgtcattaatgggctggcaacggcctttgggttccttgtgtcaatcgttcttatggcaggaatccgcgagaaaatcgaacataacgacatttcagaatcatttcagggaactccgattgtcctggttacggccggactgatggcaattgcatttttcggattttcaggtttgatttaggagggaaggaacatgagtatatcaggaatattaatagctgcggcgattgtcggcggaaccggattattcatcggcatcttcctggggatatccggaaagaagtttgccgttgaggtagatgagagggaagaggcggtcttaggcgttcttcccggcaataactgcggaggatgcggttttgccggctgttcgggcctggctgcggccattgtaaaaggtgaagcggaagtcggcgcatgtccggtcgggggatcaccggttgcagcgcagatcggcgagattatgggagttgctgcgggggatcaggaacggcaggtcgcatttgtgaagtgtgccggtacgtgcgaaaaagcgcaggatcaatataagtaccagggaattgaagactgtattatggtaaatatgatgcaggacggcggcccaaagggatgttcctatgggtgtctgggatttggcacctgtgtaaaggcatgccccttcgatgcaatccatattattgatggcatagccgtggtagataaggaaaaatgcaaggcctgcggtaaatgtatcgcagcctgcccgaaacatctgatcgaactgatcccatatgaccagaagacgtttgtgcagtgtaattctaatgcaaaaggaaaggcattgatggatgtctgcctggtaggctgtatcggatgccgcctatgcgaaaagaactgtgagaccaatgcgattacagttacaaatttcctggcccatatcgatgcgtccaagtgcactaactgcggaatatgtgcagataaatgtccgcgtaaaataattatacccagaaagataccacttacatcatagtacataatggcgtgatgccagaagccgctttgaggaattgaaatacaaataactgggatgcggtgtcagcctgaagccgcctcagaaaatgaaaaccagcataacgaacaacgacggtagctccgggaatgcagagtgcatttacgggagggctgccgggttccggaattacagtcccggaagtggttcttatgctggcttttgctatacctatgggctagcttggggaattcggttaatctgcataatgcagcgtgtagtcgtcggttacgaagatagcccggacattgtccagcgattctatcagggcggatcctttgtccagcccgagcccgaaacaggctgtgctcagggcatcaccgtccaccgaggagctggagatgattgtgacctgaaggagctggttgtcgtagggatagccggtggcgggatccagcaggtggtgatagattttaccgtctttctcgaaatacctttcataggtgccggaggagaccacagactgcccgttgatttctacggtcgtgatggcctcgtttgtctcagcgaagggcttctggattccgatatggaagggctgcccgttataccttccgccgactgcaacgatgttgccgccgagactgataagtgcgtgctcaattccctgctctgtaagataggcttttagctcgtctgcaatgaaacctttggcgataccgcccaggtcaatcgcagcctcaggatctgccagggtgaccgtatttttgtccagaatgacattcttatagttcacgtggcttctggctttctctatggaatcctgatccgggatatttccgggattatttttcacatcccatagctcactcaaaggggctatggtgatatcaaaccgtccgtccgagagccgtccgtaatacagtcccttttccagcagttcggctgtttcggggtctacttccacgggagcaccctgtgcggcgttaattttggagacgtcgcttgtctcaatggttcggctgaaaaggttttcgtaacgggtacacatttctttgcagtgctccagtatggatttatccgtggttccccagacctccacggatatgacggtgtcaaagtacatgccggtcatcttgatcgagctgtcggcacggggaactttgctgcagccggcagctgtaagcaggatggctgcggttagaagaagtgaaagggtacgtttcagcatggcttgtttcataggattcctctttcggatgtatttaaggacctgccctgcaggacggtttccatttggattattataaccattttcaggaagaattacaatcgaacatgtggttgcattctaaaagttggtgtgctatgatagtggctggaggcggatatgaaaaaaaatgattttttattaatcggactcattttactcatcgcagtttctgtgatgggttatcattatctaaaggaagacactggcatgggaaaagcagtgatccgggttgacggcgaactatatggggaatatgatttgtcaaaagaccagaccatagatatacaggggactaacaccctcgagattcttgacggtaaagccaggatgtccttcgcagactgcccggataaactatgtgtgcatcagaaggcagtctcaagggacggggagagcatcatatgcctgcccaataaggtcgtagtatccatcgaaggcggggaagaccgtgaaatggatgcggtggcaaattagtggtgtccgagtccaagcgtacaggaggaaaaggcatgaagaacagagctgcttattttggagtgtttacggcccttgcccttatattcagctatgtggagatgctgattccgatacaattcgggattccggggattaagctggggctggcgaacctgctgatcgttatcatgctgtataagtgcggtgcaaaagaggctctgctgctttccgtagtccggatcgtgctggcgggttttatatttggcaatatgttcagcattatatacagtctggcagggggggttttaagtatggcggtaatgacggtattaaaaaacaggggatccttcagtgtaacaggagtcagcatcgccggaggcgtgtttcataatatcggacagcttttcatagcgatggtggttgtggagacatttaaagttggttattatctgcctgtgctgttgattgccggcgtcattacgggagcactgatcgggctgatctcgggtgaagtgctcaaaaggctgaaaaacatgacattgatgtaaaaaggaagcttatattatgaacctagtacagcattgcactattaattcagcaatactgtactagagaaaaggggaaaacgatgatttcatatattcgcggcgaacttgctgctgtggagacggaaaaagtaatagtggatgtgggcggtgttggatacggcatttatatgcccggacaggctatggggctgctgcctcagccgggaactgaagtaaagatccacacctatctgaacgtgcgggaggatgcgatgcagctgtttggcttcctgaccagggatgatctggaagtttttaagctcgtgatcggcgtcagcggaatcggccccaagggcggcctgagcatcctttcccagctgacaccggacgacctgcggtttgcagtgctgtcgggagatgtgaaggcaatctcagcggcgccgggaatcgggaagaagacagcggaaaagctgatcatagagttgaaggataaactcaatattgaagatgtgcttacgcatgcggcggacagcagcgcggccgcggttcctgtcaataacggcgggatccagtccgaagcggttcaggctctggtggcactgggatatggaagcacggaaagcctgcgcgcagtcaaacaggtagagctggacaatgcgaccgtggaggatgtgctgaaggaagccttgaaaaaaatgctttaatttcatgacagagggaaagtatgggaaaacgaatcataacaacggaaaatctggaagaggatgtaaagatagagagcagcctgaggccgcagcatctggaagattatattgggcaggaaaaagcgaaagaaacgttgaaaatctacataaaagcagcaagggagaggcaagaggccctggatcatgtgctgttctacggcccgcccggactgggcaagacgaccctggccgggattattgccaatgaaatgggtgtgaatataaagattacttcgggcccggcaattgaaaagccgggggagatggcggctattctgaataatctgcaggagaatgacgttctgtttgtggatgagatccaccggctgaaccggcaggtggaggaagtgctgtatcccgccatggaggactatgcgattgatatcatgatcggaaaaggggcaacggcccgttccatacggttggatctgcctaatttcacattggttggcgcaacaacccgggcgggtatgctgacggcgcccctgcgggatcggttcggggttgttaatcatctggaattctacacggaacaggagctgaagacgattatcatgcggtctgcccaggtattgggtgtggagatcgacgggaacggagcgttggagctggccaagcgctccagggggacgccgagactggcaaaccgtcttctcaagcgtgtcagggattttgcacaggtgaagtacgatggagtcattaccgaagcagtagccaattatgcactggatctgctggacgtggacaagtacgggctggaccacattgacaggactatcctgctgacgatgatcgagaagtttcagggaggccctgtggggctggacacattgtctgcttctatatctgaagatgcagggacactggaagacgtttacgaaccgtacctgttgaaaagtggttttatccagcggacacccaggggaagggtagcgacggatctggcctacacgcacctgggaatcccgctttcagactgagaaaccttcctattgcagctgatgaaataggaaataacttgaaaaaatggttggtttttgtattcatatagtttataataacaggtaagaaacgcgaggagggttactgcttacaggcaaaacctgtaaaagtaacgttgcctgtccattttaagccgcctttggcgaggggcaggctcatcggctgttttacgttgtcgctcccagcctattagctagtgacagtctagggagtgaacagtaactgaggaggatgctatgagttcagcaaaacattttacagaagttttaattggaggaaaggtctacacattaagcggatttgaaggcgaagaatatcttcaaaaagtttcttcctatctgaaccataagattacagaatgtgccaacagcgaagggttccgtaaacaaagcgccgatacccggaacgtgctccttgccctgaatatcgcagacgactattttaaggcgaaaaagcagggtgattcccttgaaagtgatattgaactaaaagacaaagagatgtacgacctgaagcacgaattgatatctgttcagattaagctggagaacgctgagaaggaactggctaagatgaaggaagagaataacgatctgcagatgcagattgtaaaattagaaactgagatgaagaatcgcagaaaataagagtaggctgtcattggacagcttatttcatttatcccaggcggaggaacatcattgacacaggatagaaaaggaagcaaaaaaatagagatactggcgccggcgggttcttatgggagctttatggcggctgtaacggcaggggcggatgcagtgtatgcaggcggccctcgttttggtgcaagggcttttgcggataattttacggaggagcagctcctttctgccattgattatgcacatcttcatggcagaaagttctatctgacggtgaatactcttttaaaggatgccgagcttgaagaactgcacgaatatctggaaccgctttaccggcaggggctggatgcagtgattgtacaggatataggcgtgctttcatttgttagagagcattttccgggaatggatatccacgccagcacacaaatgacagttacaaatacagagggtgctctgtttttgaaagagcagggggcggtacgtgttgtgcctgcaagagagctcgctctggaagaagtgtacgatattgtagagcagaccggccttgagatggagtgttttgtccatggggcgctctgttactgctactcagggcagtgcctgctgagcagcctgattggaggacgcagcggaaacagagggcagtgtgcgcagccgtgcaggctcccctatactgtgaatggaaaaaaagagtacactctgagtttgaaggatatctgcacgctggaattgatcccggaattggtggatgcggggatcgattccttcaagattgagggaagaatgaaaaaaccggagtacgtagcgcttgttacggccatgtatcgtaaatatacggacatgtatctccaaaaaggcagggaggggtatgctgttgctcccggggatctggagatgctgatggatatctataaccggggaggcttcagtcagggatattacaggcagcataacggacggaatatgctttctccggatcgtccgaaccatgccggtgtgcccgcagtgcgggttattgcgcagaaagggcgtgagattgcagtggaggcgctgacggatattcacaaaggagatattctggagctggaaggcgaaaacgccggagagagcggcagggctttgggaaccaaagccgatgcggacccacagaaatggtacacttttggaacggcggttccggcaggcggcagatcgaagattctggcaccacgcaaaatgacaatgaaaaagggaactatattatgccggatccgaaaccttgagttgctggagtttatacaaaaaagatatatagacagaactgcgcaggagaccatatgcggaagttttcgggctgccgttcaggagcctgcggttttgacgcttgagttccgggagatcacggtttcggcggagacagaagagcggacggaagctgctaagaaccagccgttggatgaagagagaatcaagaagcagcttatgaagaccggtaatactgaatttgttttcgaatccctggaagttacaacggaaggccctgtatttctgccaatgcagagattgaacgaactcagacgcagggcgctggaacttttggcagaagccatttgtaatcagtatagaagaaacgtcgctatgccggaacaaggacgaaagaggccggatcctaaacgaatagcggtggaaaagcaggcgccctatctctccgtattaacggaatcggaagaacagacggcagtggcagccgcgtgtccggaagtcttccggatttacctggacagcagttccgggacggattttataaataacggcagttataaagaaatatcccgggtggcaaaaggacgggggaaagagctgtttcttgcaatgcctcatatattcagagaaacggcggtgtcctattatacggaaaatatggggatactggcggagtttgacggatttttagtccgcaattatgaaagttttcattttctgcggaaacatggatttgacaagaagatcatattggaccataatctatatgtattcaatcagtcagcgaaggaattctggaccagctgcggcgtagagagcattacggcgccggtggaattaaacagggcagagctggaacgcctggggattgaagaagccgagcttgtggtctatggacggctgccggtcatggtgtctgcacaatgtatcgtaaaaagcacgtcgggatgtacgaatacacccggcatcacggtaatcaaagacaggtatcagaaagaatttcctgtaaatcgatgctgcagattctgttataatgtaatgtacaatatgaaaccggtctttcttctggatcaaaaggaagagatctgcgggctctctccggcagggctgcggatcatgtttacacaggagagcgggcaggaagcccggatgatcctggatatttacagagacatatactgcagcggcaggcaggtccgtacagaggacatggcttttactagaggacattttaaacgaggaataacataaagcaggtgaaaaagtggttaatattgtagtagaattatcgaagtatattatgattatactgatggcagtgtatacattttcctgtttttccatattcgcccaagtgtatgaggaagacaaaaaatggatattaatcaggcagaatgtgctgatgttcctgattcagtttactgcctaccttgtcatgtatctgcagacgaaggaaaagaagctgatctttttctacggggcacaggtcgtgcttttgatcgcagtacttgtactttaccgggtgctttatccgaaagtatcccggctgattgtcaataatatgtgtatgctgctgagtatcggtttcatcatgattacgagactgacgtatgctaaagcagtgaagcagttcgtctttgccgtggtgggaacggtcatcgggctgtttgtgccggtgctgatacggaaactgaagtttttgaaggactggacatatatctatgccggagttgggattctggccctgggcgcggttgctgtgctggggcagctctccgacggtgcaaagctgggattcaccattgcgggatttggaatccagccctcggaattcgtaaagattttatttgtattttacgtggcggcaagcctgaacaagtctacggagtttaagaatgtggtggtcacaacggctgtggctgggctgcatgtgttgattctggttctgtctacggatctgggcgccgccctgattatgtttgtggtttatctggttatgctttatgtagcaacaaggcagcctctttatgcgctggcaggcataggaggaggcagtgcagccgcggtgctggcataccaccttttttatcatatccaggtcagggtttctgcctggaaggatccctttgcttcatacagtgaggggggataccaggtcgcgcagtccctgttcgcaatcggaacaggaagctggtttggcatgggcctgtaccaggggcttccggacagcatccccgtagcggaggaggattttatattctcagccatctcagaagaaatggggctgatatttgcactatgccttgttctggtatgcgtcagctgttatgtaatgttcctgaacattgccatggcgatccgcaaccagttctataaactgatagctctgggccttggaacctgctatattttccaggtgttccttacaatcggcggtgtgactaagtttattccttccacgggagttacgctgcctctgatcagctatggaggcagttccatgctgagcacaatgattatgtttggaatcatacagggcttgtatattttaagagaagacgaggaagagattattgagaagagaagagagagagaattacgaagaagtgaacagccaggaaaggcgccgcggaaaaaacagccgggcaaaaaaccagcgttcgaagaagttccgaaacaaagagttcgctagggtcacgtacttgtttgtcgctctgtttcttgccttaatggcctatatggtatattttaatatcgttcgtgccaagactattgtaaacagcccgtataatgaacggcaggatgcatttgcggatcgggtaatccgcgggaatattgtagataaaaacggaaatgtgctggcggagacgaacgtagcagaggacgggacagaagtgcgcaattacccttatggcgcagcttttgcccatgtcgttgggtacagctttccatcaaccgggaagagcgggctggaatccgttgagaactttgaactgcttacctcgaatgccttttttccgcagaagctgatgaatgaattcaaagacgaaaagaatatgggagatactgtagtcacaacccttgacgcagatctccagcaggctgcctacaatgcacttggcggtaataaaggggccgtggtggtgatggaagcaagtacagggaagatcctgaccatggtatccgggccaacttatgatcccaacagcgtggcggcagactgggaagcactgaatgcaaacgacagtgaaagtccgctgctgaaccgcgctacacaggggcagtatgcgccggggtccacatttaaagtggtaaccgcactggaatacatcagggagcacagtgattatgcgaattacagctatgactgtgccggtgagatcaccgcagagggagttacgatccactgctttgacagtacagtgcacggcctgcaggatctgagaagctccatggccaattcctgtaattcctcttttgctaatatcggtctctctctgaacaaaacgtcttatagggaaactgcggaagaacttctatttaataagaagcttccgtctgtcctggattactcgaaaggatctttcagaattaatgagaattccagcggtgcggaaatgatgatgaccgccatggggcagggcgagacactggtcagcccataccatatggcattgattactgcagcagttgcaaacggcggcactctgatggaaccatatcttgtggagaaggtaactaatgcaaacggagcagaaatcaggaaaaatgttccaaagagctataaaagactgatgacttccgatgaggcatcccagttaaaggattatatgaaggccgttgttgacgagggtacagcaacgatgctgagcggccagtcctacacagttgccggtaagacaggaacggcagaatacagcatggatgacggggagaagacgcactcctggttcatcggttttacaaatgtagacaatccggaactggtgatcagtgtaatcatcgaaggatatgacggagatgcgggggcaaaggcagtgccgattgccaagcagatactggattcttattactattaatgccaggtggtgaagagtatgcaaatgacattttactgtaacttatatgtcagtgaggatctggaggataaaaaggagaaggtcatgcagaagctggaaagcaacagcctgcagccttccgtctatgtcatcacgctttcgcagggagagcagaatcatctggaattttattcttccctgctgtacaaacagcatatctatgaaaatacgcccgtatttgtcgtggggattgcgaaaggatatgatgatgccctctatctggtggaggctattgcagaagatatctataaaaagaccaatgacctggatatacggggctatatccagaggcgccaaaaagaatatgaggaaggcagagtgtaaaagcggatgttacatataatccttttgattctaaaaattataggatggatattgcttgcaatactgggcttactggtattgctgatttgcattgtcttttttgtgcctctgcgttacagggcggaggggaggtgcaggggaaccctggactctctctatgggaagatccggttttcgtggtttatgcatcttgtgagcggcagtgccgtctatgatgggggaaagctcatgtggacagtacggatcgcctggaagaagctgtatgggggcgcggaagaagactgggaagaggcacacgagcccgccagggctgcgaaacatactgaagatgaggattacgagcctgccaaggctgtaaaacataccgaggaggaagatctgaaagcgctggaagagctgatggacaatggcgcacagcagcggctggaagaccagaaggacaagaatatagtggaagagaagccgccggatgcgagccggacgtataaggagcagaaggaagggcatttacaggaaaaatatagagaagacgatccagcggaggaaaacaatctggaaaaactgctcagggaagagatgcgtgattcggtagaggaaaatgagaatcattcagacaatcagcgctccccgtcaggtgatgaaaaaacagaggcagaaagagaaagcattgcttccagagttgagaaaaagtatgagaaaagcgtaaaatggttacagaaaatttatcataagataaaatatacttttaagaagatttgtgataccataaggtcattattggagaagaaggacacactgctggagttcatagaggacgaggtccacagatccgcattcttcacggcactcaaggaactgcggcggctgttacgctttttgaagccgaagcggctggaggcagatatccattttggatttgaagacccaagcataacgggaaaggtgctcggcctcattagtatgatatatccgtttctgggaaaacatacaaatattcagccggattttgaacacagggtactggaaggggacattgcaatttccggcaaactgcgcgttctctatgtggtgattgtgggatggaatctcatatggaacaaaaacgtgcgcaccacattcaggcatatcagaaaatttgaactgtagcaaaataagtatgaaagattaaggaggattcaggcatggcagaaggaagtaattttaaggagactgtggaggcgttatttcagggaatggacaatgttgtgacatccaagacagtagtgggggatgcgatccacatcaacgataccattatcctcccgctggtggatgtatcgtttggaatgggcgccggttattttaacggtgataaaaaaggcagaggcacaggaggaatgggcggcaagatcaccccaagcgcggttctggtcatcaaaaacgggacaaccaagctggtcaacatcaagaaccaggatacgatcaccaagcttctggatatggtaccggacatggtagacaagttcacaacgaagaaagaagacaaagtgaccgaggatgatgtcatggatattctgaattccgaagattccactgaaaatgatgcacaaatttaaaatccgggcataaaataataccaaaccacctgccggaagcgggacagattatgaaaaaagtaatagggtttgcattactctggtttgcaataggaatgtttgtcatgctggcactgcccaacgcaatcggactgctggtcacattcatatgtctggcggcaggatataaattgttttgtgggtagggacgctgagggagagtcgggactggtttccggcagggctgcatatgccgtttggatgcccgcgccacttgataagaagcagtaacagtgaaaatgcggggaatagaggtacttgccgcagttggcccgaatgccgatgcattcgcgccgccggcggcaacaggatttgattttgaaaatcaaatcctgccctctattccccgcattttctctgtaactgcttctaatcgcgttctgagggcgtccaaacggcatatacagccccgccaaaaaccagtcccgactctccctcagctaggcgcatccggccgggacggacgggggcggcgtatttgccttcctgcgcggaagtatctatgtataaggaattgttgaaaattggtgccacaggcgattcatcttacatataggtagttaaaggtaggggcattccataacaaccatctccagcccaatttatccgttttcccagcccaatccgccgccaccgcaggtacctcccccatttttacgcttttttcttccggccggatgcgcctagcctgtgcaaggaggggaagatgcggctgggaacagggaatgctctttctgaatgcgtaaaatgcgcgttagaacggcttaatgaaaaacctgctgtattttgaggatgaaatcggctcacaaagccggtttcaaggagacctgagctgcacaatcatcaagattgtgcagtgaatgtctccggtgcctcaaaatacagcaggtttttcatttagccgttcttagcaaatgacccgtatacagaaagagcattccctgttcccagccgcatcttcccctccttgcacaggcgccccatccagacactaaaaatccgtataaaaaaagtacccactttatagtgagtacccccgtgtcgtttgatgtccagattaagcacgttctacgcgtcctgattttaagcaggaagtacaaacgtacattttttttgatccgccttctgttttaactctaacggatttcacatttgatttccacatctttggtgattttctatgagagtggcttacattatttccgaagtgagcacccttttcacaaatagcacatttagccatcattgcacctcctaacaatctgaaatagtccttacagactcacaacactgttattttagcagaaagaatttctaaaagcaagcatttttttgaatttatggaagtaaaatgaaaaaagaaggcggtttttcttttttggttcccataatttcgaattcatgttaaaattgacatagaatttaaacaagaaattaagccttcaaaccgggcggaaagtggggaatactatgggcagacgagtaattacgattggcaggcagtacggaagtaacgggcatgatattgcaaaaaaattatctcagaggctcggaattcattattatgataaagagttgattaagatagccggagagaggcagcacatttcctatgaagaactgcttaaggtggatgagaagagagcgaatccgtggagatatccggtggaggacgaggtgcagatggatcggaagttccgctttgaacctatgaatgatgttcttttctatacgcaggccgagatcatcaaagggcttgcggagaaggaagactgtatcatcgtgggacgatgcgctgacgagatactgaaaggtacaaatgggtgcagaagcgtttttatacatgcgccatttgaaaagcgggttgagagaattatggagcgtgcctccattgacgagcgtgaggcagccacccttataaaaaagattgacaaacagcgcagatattattataactactttacggacaaaaagtgggaagatatgactcaatacgatatctgtctggacagcggaagcataccggaggagcagattctggatgttttggcagcactttatgaatctatattgtaaatttgtgataaagagagtataatacctgtgttgattatgcgaaaaatccattcgagaactggaggttatatatgatgaagggtagcatgagtacggatcttggaattattacgatcaatcccgatgtaattgccaagtatgcaggctccgtggcggttgagtgtttcgggatcgtcgggatggctgcggttaatatgaaagacggctttgtcaggctgttaaaaaaggaaagcctgactcacggaatccgcgtggagctttctgatgataatatactggaactagattttcacgtgattgttgcttatggagtgaacattctttcagtctctgacaatctgatgaacaatgtaaagtataaggtagaggaatttactggcatgactgtagataaaataaatatctacgtcgaaggtgtcagagtgattgattaaggaggatactcgtcgtggcaacaaaaacgataaatacagagctgcttaccaggatgtttttggcgggggcagcgaatctggaggctaaaaaggaatttataaacgaactgaatgtatttccggtaccagacggtgacacggggacgaacatgacacttacgattatgtcggcggctaaagaagtcagcgcgctggaacagccggatatgctgtccgtgtcaaaagcaatctcctcaggatccctccgaggggccagagggaattcaggagtcatcctgtcacagcttctcagaggttttacaaaagagatacgagaatacagagagatcgacgtacaagttcttgcccaggcatgtgaccgtgcccgcgctacggcatataaggcggtcatgaagccgaaagagggaaccatacttacggtagcaaagggcattgcccagaaggcggcagagatggcagagacgacagatgatctggaagtttttattcccgaagttctgaaacatgcggaatatgtgctctcaaagactccggatatgcttccggtgctgaaggatgccggcgttgtagattccggcggacaaggtctggtagaggtattgaacggtgcatacgacgctttccagggaaaagagattgattacagcgccattgaggcaagttcaggcacaagtatggtgaggcccggggcacaggcggagacagatatcaagttcggatactgcaccgagtttatcattatgacttcaaagccattctctgagacgaatgagacggagtttaaggcttatctggaatccatcggcgattccattgtgtgtgttgcggacgatgacattgtaaagatccatgtacacacgaatgatcctgggctggcgatccagaaggcgctcacctatggacagctgtcacgcatgaagatcgataacatgcgcgaggaacaccaggagaagctgatcaaggacgctgaaaagcaggcggctgagcagaaaaaagcggttaaaaagccggaaaccagaaaaaaagtcggtttcattgcagtatctatcggtgagggaatgaatgagatattcagagaactcggggtagattatattattgaaggcggacagacgatgaatccgagcacggaggatatgctgacagctatagatgcggtgaatgcggatcatatcttcattcttccgaataataagaatattattctggcggccaatcaggcgcagtccctgacgaaagacaaggatatcctggttattccgacgaagactgttccgcagggaatcacggcggtaatcaattacatgcctgaggccgatattgataccaatgccgagaacatgaatgaagagatcaaaaatgtaaagagcggacagatcacatatgctgtcagggatacccacattgatgacaaagagatccatgaaggcgatatcatgggaattggcgacgcagggatccttgcagtaggacagtctgtagagggcgtggcaaaagagatgctcacctcactggtagacgaagatacggagctgatcagcctgtattacggacaggatgtcctggaggcggatgccgtccgctttgcacaggagatcgaggaattgtatccggatgcagacgtggatgcacattttggaggacagccgatatattactatgtattatccgtagagtagaacagatcattgcagataaggcgggccagtttcccagaagggaagctgacccgtttcgaactcaatcctgttttgtaattgtccgatgggagaataaaaagacctatgaatgaaaattctaaaataagcacactaaaaggaatcggtgagaagacgcaggccctgtttgagaaggcaggcatgcggacaatcggggatctgctgcggtattatccgcgtggctatgatgtctatgacgagccggttccggtcggagaggcagaagaaggcaggacggtaactattaccggcgctatatttggaagagtgcagcttgggggaagcaaaaatatgcaggtgacgacgctctacgtcaaggatctgacaggcactttaaaagtgatctggttccggatgccttttctaaaaaatacgctgtccaggggcgggattatcactctgcgcggccgtgttgtcagaaaaagggacggcctggttatggagcatcccgagatcttttatccgagtgcaaaatacgaggaaaaaagaaataccctgcagccggtgtatccgctgaccagcgggcttacaaacaatgcggtaaaaaaggccgtgatgcaggctattcagtatctggatctgaggcaggagtttctgccggaggacatccgcatgaagtaccatctggcggaatataattacgctgtccgcggcgttcatttcccggagacaaaagaagaattctattatgccagggagcgccttgtatttgaagaattcctgattttcatcctttcccttagaaatctgaaggcgcgggaggacaaagcggtaaatggatttgcatttgcagagcggccggagatcgataagtttttagcgtctctcccatatgaattgacgaatgcacagcaaaaagtctggggcgaaataaaacgggatatgtccgggcccaatgtcatgtccaggcttgtccagggagacgtcggctcgggcaagacaatcgtcgcactgctgggtctgatgtatgcagggctgaatggtttccagggggctatgatggcgcctacggaggtgttggcaaagcagcattacgataatattacatccatgttcagacaatatcacatcccattacatgccgagctgctgacaggctcaatgactgcaaaagagaagcgggaggcttacgaaagaattgcctcaggagagtcggacatcatcgtaggaacccacgctctgatacaggagaaggcagtataccataatctggctctggtagtgaccgatgaacagcaccgtttcggggtaaagcagagggaaatgctggcggggaagggaaagatgccgcacattcttgtcatgagcgccacgccgatcccgcgcacgctggcgattatactatacggagatctggatatttcagtgatcgatgagctgcccagcaaccggctgccaattaaaaactgcgtggtggacaccggataccgcaatacggcttatcgttttatgcagaagcaggtggaagcgggacgtcagtgctatgtgatctgccccatggtggaagaaagcgaaaacctggaggccgaaaatgtgatagactatacagagctgctgagagaagcgctggggtgcacaattgaaatctcttttctgcacggaaagatgaagcaggctgaaaaagatgagatcatggaagcattcggcaaaaatgagatccagattctggtttctacgacagtcattgaggtcggtattgatgtgccgaacgccacggtgatgctgattgaaaatgcggaacggttcgggcttgcccagctgcatcagctgcgcgggcgtgtggggcgtggaaaatatcagtcctactgcatctttatgagtgcctcaaaatcaaaagaaacaaaagaaagactggagattctaaataaatcaaatgatggtttttttattgcatcagaagatctgcgtctcagaggaccgggcgatctgtttggaatccgacagagcggcctcttagattttgctctgggggatgtattccaggatgccaaaattcttcagaaggcaaatgaagccgcacaggaacttttagaaaaagatccggagcttacagaggaaaaccatgcaaaaatgaagacccatttgaacaaatacatgtccgaaatgatgttagagacaaccctttaagcccgtaaaaccgctgttttaagttgatttacaaaaatcgttaaaggaggcaggaacttccagtgtaaaagataaaaacctccatatactatggttgtaacacacaacagtgttataaaaaaatctgaaaaagtaacagaagttacgagaaggaggaaattatcatggcaagtcgttcatctaatcgagcagccgtaccagaggctaaaagtgcactggacaaattcaaatatgaggtagccagcgagctgggagtaccgcttacagacggttacaatggagatttaacttctaagcagaatggttctgttggtggttatatggttaagaaaatgatcgaacagcaggaaagacagatggctggtaaataagcaaatttcgtaagaaaaagcacttaggattgacctaagtgcttttttctgctaaaattcagcatagttagaagattttaaaagttcatacaggtctgcgcatttattgcacagaccgtaggaaaaccttgcgatgaaggcatccagcccatcgcaaagccagtttaatagctggatgcgtaaccgttcaggcttttctgaactgttacagaagaatgagggtgttgtttatgagagtgattgcaggaagtgccaaaaggatacaattaaagacattggacggtctggatacacggccgacgacggacaggattaaagaaactttgttcaatatgattgcgccgaccatctatgacagcgtatttctggatttgttcggcggaagcggaggcattggcatcgaggctctgagccggggggccagggaagctgttttcgtcgagaataacccaaaagcaatggcatgcattaaggagaacctcaaaaatacaaggctggagtcaaaggcgctcacgctgacaagagatgtaatggcggcgctctatcagctggaaggcgacaaggtattcgactttatatatatggatccgccttatgacagggagctggagaaacgggtgctggaatatctcgccggatccgaactggtgtatgaggataccgtcattattgtggaggcctcaagggaaacagatttttcctatcttgaagaactggggttttctatgttgaaagagaaaatgtataaaacgaacaaacatgtcttcattgaaaaggccggaaaggaagaaatatgttaagagctatttacccggggagctttgaccctgttacatacgggcatttggatattatcaaaagatcctgtaaaatcgtcgatgaattaattgtcggagtgctgaataataatgcgaaaatgccgttgttttctgcagaagaacgtgttaaaatgttagaggaagtaacaaaagacttgacaaatgtcaaaattgtcctgtttaatggactattgattgattttgcaagacaacagggggcagatgtcgtaatccgcggtttacgtgcgattaccgattttgaatatgagttgcagatgtcccagacgaatcataagctggaaccgagcgtcgagacgatgttcctgacgacgagtattgaatattcttacctgagttccactaccgtgaaagagatcgcagcttttgggggagacgtatcacaatttgtgccggaagctgtgtcatcggagctggagaaaaagatgaacgctaaaaggagagtgtaactatgagcagccgcattgagcagattattgaggagatcgaagagtacattgacagggattgtaagttccagccattgtccactacaaagatcatcgtaaataaggaacatctggacgagttattgcgcgaactcagaatgaagacaccagatgagattaaaagatatcaaaagattatcagcaaccgcgatgcgatcctggcagatgcccaggcgaaagcggacgctatgatagaagaagcacaggtacagacaacagagctggtcagcgagcatgagatcatgcagcaggcttactcccaggcgaatgagattgtaacacaggcaaccgcacaggcccaggagattattgacaatgcaacggcggacgccaatgcaatacgcatcggtgcgatccagtatacggatgatctgctggccaacgccgagagcataatcgggcatacactggacagctatacgaccaagtatgacggtctgatcaattcccttcaggagtgttatgatgtggttcgtaccaaccgtgctgaactggaagtgcctgtcgacgatgacagccagtatattccacaggatggattagatgatctgtaaataaagaacagcaatcaggctggccacccccgcggtggccagcttttctaatgtataggggacgacggagagtgaggtcttctgtatcatgcactgtgtctgtgcggcggcgcatatgccgccgaaggaggtaagtgccagaattgcagggtactgaatcgtaaaaggcagtgtagatttcccaatcagggcgatcccattcgtgacctccagtgccggcagtatcatctggactggagccggctgccagggtgcggactgtacgagagctagtatcacggaaaagagaatgatgtatccgccgacctttgtaatggtttcaaaactgtccatgatacaggtatcaacaatgcggaatccccagtccgttttgctttggccggtctttttcatcgcgggaaagtttttttgcccgtgcagatagaatcttctgaagggaatgctcatcagcatgggcgtgcccaaaagaatcagaagtgaggggagaagatattcttccctgccaagtgttttccaaacgatgaaattcaggataaacacggggctggtattattgcagaaagacagaagataacggccttcatcctctgtgatatagcctgttgcaatcaggtcggcggttactttcgcccccatggggtatccacagagaaaaccgacaataatagcaaagcttccgctttcagatactttaaatatgcggcacagaaccttgccgaatgccctggatatgtaatggatactgtcggtgcagagcaggaggttggtgatgatgataaagggaaacagggtcggcagaatgatttgaaaccagagaaggagcccctcactggctccgttaaaaaccgccttgggagatataagcatgaaagcaaaaaggattacaatcccgattccggccaggttatgtttcataagagttactccttgcagatcagccagataaatgttattaaagatatatgaaacgggttgattttttataccctctgtgacaaaatggtaacagttcagaaccgtttgaactgcgatactaatgagaacaatccagctgttcagaacggaacagctataacataacagccatataggaaggggaatataacaatgccgatattaaatgaattggaaccagtggaagtgtttcactattttgaggaaataagccggataccgaggggaactttcaatacaaaagcagtcagtgattactgcatgacctttgcggcagagagagggctggaggccattcaggatgaattgaataatgtcatcatcaaaaagcccggaacaaaaggctatgaggagagtgaaccggtcatcatccaggggcatctggatatggtatgtgagaaagcagagaattcggagcatgatttcacaaaagacccgctggatctctatgtagaggatggttttgtaagggcgcgggataccaccttgggggctgacgacggaattgccgtggctatcgcacttgcactgctggacagcagtgacatccctcatcctccgctggaagccgtctttacggtggatgaggaagtggggatgggcggagcggaggggattgaccttacaccgctgaaaggaaagatgctgctgaacctggattcagaggacgaagatacaattatagcaggctgtgcagggggcttaacctttcgcctgaatctgcctgttggcaggaaaaaagctgcaggcagctgccttgatgttacgatccacgggttgaaaggcgggcactcaggcgtggagattgaccagcagcggggcaacgccaacaaactggccgggcgtcttttaaacaggctgaaccagaatatggacattgcccttgttgaggttcagggcggtgcaaaggacaacgtcatcacttctgtcagcaaattcaccatcgttgtgcaggatagcgtaaaagcagaactgatcatcgagaacatgctgaatacctggaggcaggaattcggcgcagatgagccaggacttgatatcacagtcactaagaccgaatatgaggagaaatccgttttttctgatgcggacaaaaacaaggtcatctttttcctgaacaactgccagaatggagtgtacggttttagcaggtctttaaagggcctggttgagacgtccgacaacctgggagttgtgaagaccggggagagccagatctcctttatcctgttgatccgaagttctgtttcttccagattggaggaactaaaggaagctttgacaggctgggcagaattcctgggaggcacttacgagattaccggttcctatcctgcatggatgtacaaagaagattccagaatccgtccgatcgtggcaggggtattcgagaaggtctacggaaaaaagccggagatatctaccatacatgcaggactggaatgcggcctgctgtccgggaaaaagccggaactggactgtgtatccttcggccccagaatgtttgatatccattccgtccacgagcggctggacattgcctcaacctggcggatgtggaatataatcaaagaaatcctgaaagaatgcaaataggacattctcctgctcatatattaaagtgattacgtgtgcagaggaacatctgaaaagttgaaaagaaaaagattgcataactatatccttctgaatctgcttctggcgtttttcctggcagtgggcatccatgaacttctcatacagggaggttacgcccggctgaatgaaaatacagctgccggagacggtttcagaaggcaatccctcaatgaggagatgctgaactacatacagaatacaaaagacccgggagaaaacctgggcctttattggctggaaacagatttcgggacagacccgttgaagaaaacccccgatccggagctgttctccgaactcaaaaagcgatgggccggccgccagggctgggaagaatacatcgcacagtgcaggggaatctggaacgacgtcaagtatttcccagtacctgcgcccaccggtaaaacggaggctggagtatcttttgtagattcctggatgtatgagcgcaattacggcggcaagcgcggtcatgagggaaccgacatcatggcagacaagaatgagagaggcctgtatccggttgtcagcatgacggacggagtagtgcgccacaaaggatggctggaacaaggaggatggcgccttggaatcgtggccccgggcggcgcctatttctactacgcccacctggattcctatgcagacatagaagaaggggacaccgtacaggccggggacctgctgggctacatgggagacaccggttacagcaaaaccgaaggaacaacaggaaactttccggttcatctgcatgtaggaatctatctgttccataatgacgaagaaatcagcgtcaatccgtactgggtactgcgctatctcgaaccccacaaaatacagtattcttagcttacgggctttagcccccgggtgcggatgggggggacgccgggcgtggaatgggatggggacgcacggggatggggcagacgcaagacggctcaagggggtacctgtcatttcaaaatgcggacacgggactaagaaattctaggaggcaagcagccatgaaaatggggcacagctgacacatcactagaaatcctgatgatttctcgcgctgggtcagcagcttctgtgattcggaatcacagaagctccccattttcacggctgcttccctccaagaatttctaagttccgttttagcatttttgaaatgacaggtacccccttgagccgtcttgcgtctgccccatccccgtgcgtccccatcccattccacgcccggctggtacatccggaggaagaaaagaagcacgtaacctggttgggagaatagacgggggaggcggatggaattgcctgcgtcagcgtaatccctccgtgagaatgcgcattacctaccgtttggatgcaacagcaaatgacgaggcggggacggctcatggcgggacaatgtctgctggtgaaaagtccataaagcaagcgttttcttctacagcttcttagcgaagtgtcaggacatttcaccagcagacattgccccgccatgagccgtccccgcctcgtcatttgcgtcccccctcatcccaaaaagtgtctccccattcccacatttagctctagtcctaccgtgggatttatgatataatcagtttcatgtggaggatttgatatgaacttaccgaaagcatttgaagagaaaatgaaaggccttctgggagaagaatatgatgcctacctggagtgctttgatgagccgcgccactatgggctgcgcgtgaatacaaataagatcagtgtggaacagtttatgaacattgcaccctggccgcttgaaccgattccgtggatttccaacggattttattatgatggagaaacggtacagccagcaaaacatccttattactttgccgggctgtattatctgcaggagccgagcgctatgacgcctgccagccgcctgccggtggaaccgggggaacgggttctggatgtctgtgcagcgccgggcgggaaggctacggaactgggggctaagctgaagggagatggcgtcctgatcgccaatgatatcagcaattccagggcgaaagggcttttgaagaacttggaattgtttgggatcggcaatatgctggtgctgagcgaagaacctggaaaactggccgaatattttacggagtattttgataaaattctgattgacgccccctgttcaggggaaggcatgttccgcaaagataaaaagatggtgaaggcatgggaggagcatggtcccgaatttttttccaagctccagaggagtattatcacgcaggcggctgctatgctcaagccgggcgggatgcttctgtactcgacctgcacattcgatgcctcggaaaatgagcagacgatagagtatctgatttctcattatccggaatttgcggtctgcccgattgaaccctatgacgggttcgtacagggaatgccggaggtaacagagggaggcaatccgggacttgcagaaaccgtgcggattttcccgcacaggatgaagggggaagggcattaccttgcgctgctgaaaaaagcacattctcctgaacttgaggagaatgggaatagacagaaatgcatgtcagggcagggaaagggcagaaagctgccggaggaactggcggaatttctgcaggatacatcctgggagctggatccttcccggctggatatacatggggagaggctttattatatgccggacgggctgccagagctgcgaggcgtcagattcctgcgttcgggactgcttctgggagagctgaagaagaacaggtttgaacccagccaggcgctggctatgtgcctgaaaaagcaggagtatcaaaagattctcgatttcccgctggcggacgacagagtgattaagtatctgaagggcgataccctggatgtggaggatatgactgctgtaaaagagaaaggctggtacctcgtatgtgtggacggttatccgcttggattcggcaagctggcgaatcagacactgaagaataaatatctgccgggctggcggtggatgtcttaaaaccatgaatgggataagttatgaagttaagattagataagtatctggccgatatggggcttggaacccgcagtgaagtgaagaaggcgattacaaagggattggcggaggtgaacggcgcggttgtaaaaaagccggagggcaaagtggacacagagacagacgagatccggtatcagggaaagactgtgggttacatttcatatgagtattatatgctgaataagccggcaggggttatttcttctacggaggatccgaggcaacggacggtcattgatctgatatcaggcaggcatagagacgatctgtttccggtaggacgcctggacaaggatacagaagggctgcttctgattacaaacgatggcgctctggcgcacaggctgctttcaccaaaaaagcatgtggataagatttattatgcacggatacagggagtggtgacagcggcggatgcggaatcatttgccgtgggtcttgatattggagatgagaaaagaaccctgccggcaaagctggatatactggaatcgggggagatatcgaagattcgggtgacggttcgggaaggcaggtttcatcaggtgaagcggatgttccaggctgttggaaaagaagtgatctatctgaaaaggctgcagatgggcagcctgaagctggatgaaaacctggaaatcggtgcatacagagaattgacaaaggaagagatggaagcattatgttagaaaataaaaaagcggttatttttgacctggacggctctctggtggattccatgtggatctggccggaggtggacgtgcagtatatggataaatataatcttacggtgcctgccaatttccagaaggcgatcgagggaaaaagctatacagaaacggcacaatattttctggatacattccccagtcttacctgtactctggatgatgtgcggcgggaatggatggagatgacattcgggctgtatacgacgaaggtgcctttgaagcccggggcaggggaattcctggaacatctccgctcgctggggatccggatggggattgccacgagcaatgccagggaactggtggacgcgacgctgaaggcgcttcatatcgaacagtacttttcttccgtgcgcacttcctgcgaggtggcggccggaaaacctgctccggatgtttatctgaaagtggccgaggatctgaaggtgcggccggagacctgtcttgtgttcgaggatgtcccgaggggaatcgaggcgggaaagaatgcgggcatgtctgtctgcgccgtggatgatgatttttcccggcaggatgaggcggagaagaagaaactggcggattattttatccgcaattattatgatattaagaatcatacctatgaaatttgtggagtataaatgatgaatcagggttttttaccgttatgcagaaaagagatgctggaaagaggatgggaccgcgccgactttgtctatgtgacgggggatgcgtatgtggaccacccttctttcgggccggctattatcagccgcatgctggaggcgcatggctaccgggtgtgcctgatctcacagccggactggaaagatccggggagcattgccgagtatggagagccgaggcttgggtttctggtgtcagccggcaatatggactccatggtcaaccattacaccgtctccaaaaagcggcggcgccaggatgcttacacgccgggcggggagatggggaagcggccggattatgccgcagtagtttatggcaacctgatccgccggacgtacaagcatacgcccgttattctgggagggattgaagccagcctgcggaggctgggacattatgattactggtccggcagggtgaaacgctctgtcctgctggactccggtgcagatattatctcatatggaatgggcgagcgctctgtgctggagattgcagaagcccttgaggcaggaattgccgtatcagacctgacctatgtggacgggacagtggtgaaggtgaaagaccaggactccatatacgatgcggttatgcttccttcttttcaggagatctctgaaaagaaggaggcttatgcccggagcttttatacccagtatcagaataccgatccattttcaggaaagcggcttgccgagccctacggagagaaaatgtatctcgtgcagaatccgccggcaaaaccactggatcagacagagatggatgatatctacgcgctgccttttatgcgtacctggcacccggcctatgagaaagcagggggcgtgccagccctctcggagatcaaattcagcctgacaagcagccgtggctgctttgggggatgcagtttctgtgccctgaccttccatcagggacggattatccaggccaggagccatgaatcgctgcttgaggaggccaaaatccttacggaacagccggattttaaggggtatatccatgatgtgggcggtcccacagcgaatttcaggcagccgtcctgcaacaagcagctgcagtatggagtctgcagggaaagacagtgcctgtttccgcatccctgtaagaatctgcgggcggaccacagggattatgtagaacttttgagaaagttaagagagatccccagagtaaagaaagtgttcatacggtcaggcatccggtttgattatctgcttgccgatcgggaccggacatttttaagggaactctgtgaacaccatgtgagcggacagctgaaagtggctccggagcatgtggcggatgaagtgctggaaaaaatgggaaaaccagaacataaggtgtacgaggagttcacccggatatatggggacatgaaccaaaagcttggaaaaaagcagtttctggttccttatctgatgtcttcccatcccggatcggatatgaaggccgccgtggagctcgccgaatactgcagggatctggggtatatgccggaacaggttcaagatttttatcccacaccgtctacgatatccacctgtatgtattataccggactggacccgcggacgatgaagcctgtttacgtgccgaaaaatccccatgagaaagcgcttcagagggcgctgatccaataccgcaatccggaaaactacgacctcgttatggaggcgctgaagaaggcaggcaggatggatctggtcggttttggggaaaaatgcctgatccggccgcgcagatttgcgaaagaaagggcctacaccggagagaatggcggaaaaaggactgagatcaagaaaaaaactccggttaagaaaaaagcaatcagaaatgttcataaaaagaaaaaccagaaaaaatagtataaaaagaaggtgtatagattgagaattgcaatagtaagcggagcctcatcggggatgggccgggaatttgttaaacagctgccctggttctaccgggagctggacgagatttggataactgcaagaaggaagggcaggcttatttctctggcaaagacgagcagaattccatgcaggatcttcgagggaaacctgctcgaaaacaaggtttacagtgagatactggatgcacttgagaaagaaaaaccggatgtgcgtatgctggtgaatgccgcaggcttcggcaaaatgggaacggctgcagagatcgctgaaagagaacctgaggcacagcaggagatgattgatctgaactgccgtgcactcacccgtcttaccatgacctgcctgccgttccttacacagggaagccggattgtgaacctggcatccgcagctgccttttgcccgcagccctattttgcggtctacgcggcgacgaagtcctatgtactcagtttctcacaggcactgggggcagagctaataaagaacggcatctatgtgaccgcagtctgccccgggccagtggatacggaattctttgacgtatccggcaggcttccgcacaaatggaaggacgcggttctggctgccccggaaaaggtggtgcatcaggcgctgatcgattccaggaagaaaaagccggtatctgtctatggaatggcgatgaaagcagcggatctgggagcaaagcttctgccgcacaatatgattataaaaatagagagcatgggaaaagactaaggagaactacactatgactaaggtgataaaaggagagccgggatatctggattataagaaaaaagcagagattatccggaccgtgatttattttgcactggtggctgctattttcattctgggttacagccaggcgcatacgagactgaatctgatgaccgttgttgctgtattggggtgtctcccggcgtccaaggcgctggtgggtgtcattacccgatttccctatccgtctattgcagtcatccgtgcagacgagattaaggcaaagaccggcaatataacggcagtctatgacatgatcattacaagccgggaaaaagtgatgccggtggactgcattgtgatttccggaaatacaatcttcggatatacgaacagcgaaaaagtggatgtaaaatacgcagctgcccatataaaaagtatcctgaaccagaatcattttccggatgtctcggtgaaaatcctgaataactataccgcttttctggcaagggctgagggtctcaattcgatagctgctgtggaaaaaggggatacaaaagagatagaaagacagatcaaacaggtgatattgaatatatccatgtagaaaggaaccagttttatgcagcagataacagtcggtgacaatgaagcgggacagaggctggataagcttctggccaagtatctcagagaggccccgaaaagctttttatataagatgctgcggaaaaagaatattactctgaacgggaaaaaagcttccggcagtgagatgctttttaaaggagacgagatcaaaatgttccttgcagaggagaccattgccaaatttgcgggggatgcagggctccctgcagagagacacatgaagaaagaatcctgccatgatgtgcgtctggatatcctctatgaggacagccatatcctactgattaataagcctgccgggatgctttcacagaaggctcaggacacggatgtctcactggtcgaatatctgcatgactatctgctgcagagcgggagtctgacaggggatggcatgagaacattccgcccctccgtctgcaaccggcttgatcggaacacgagcggcatagtagccgccgggaaaagcctgcagggccttcaggagctgagccgcctctttaaggaacggacactgggcaagtattatctctgtcttgtacaaggggaagtgaaagagcgctcccggatctgtggttttctgaaaaaagacgaaaaaagcaatcgggtcagtataacagactcgcccgaagcaggaagcgcggcaattgagacagaactctgccccctcaaatctaagggcggcgtgacgctgctggaggtacacctgattaccgggaagactcaccagatccgtgctcatcttgcttctgccggtcatccgatcctgggagactacaagtatggcggcagaaaactgggcgacaggtacaaaaatgcatacgggctgaaccaccagctgctccacgcatacaggcttacctttccggcactggaagggccactaagcggtctgtcgggaaaggaatttcgggccccgcttcccggggagtttcaaaaaatagcaaaggataagggtgttttatagatggctacctggaattcaagggggcttcgcggctccacactggaggaactggtaaaccgcaccaacgaacggtacgaggagatggggcttgcgctgattcagaagataccgacccccatcactccggtgaggatagacaaagagcatcgccacattacgctggcatattttgaaaagatcagtacagtcgattatatcggggctgtgcaggggatcccggtctgcttcgatgcaaaggagtgtgctgcggatactttcccgctgcagaatgtgcatgagcatcagatgaattttatggaaaagtttgagaagcagggcggtatctcctttttgattatttattacagcagttaccatgaactctactatatgcgttttaaagagataaagagattctggaaacgcgccgcagagggcgggcggaagagctttcgttatgaggaactggatccggcctacttcatggaactgaaaaataactgtttcgtcccgtacctggattacatacaaaaggatttggataccagggattgacaatcagggagaaactgcgtataatttacagggtgatttaacgaattagcacgataaagtgaaagggcaggaaatatggaacagaaattacatacacctgaaggcgtcagggatatttataatacagaatgcaggaagaagctcagaacacaggaaaagctccatgatgtactgcacgcatacggatatcaggacattcagacaccgactttcgaatacttcgatgtgttcagaaaagagatcggaacgatatcttcgagagaactctataaattttttgacagggacggcaatacactggcactgcgcccggacatcacgccgtccatagcccgggcggcggcaacgctgttcgagacagaagaataccccgtccggctctgctatatgggcaatacatttatcaaccattccagctatcagggccggctgaaggaaaatacccagatgggggcggagctgatcggcatggattccatcgaagcggacgcagagatgcttgccatggttgtagacgggctgaaaaaggtagggcttaaggaattccaggttaatatcggccatgtggacttcatacagagcctgatggatgccaccggactggaagaggaagaaaagtcggagattcacgatctgatcataaacagaaattattttggagtggaagaaatcctggacaaccaggatgcagcggacaacattaaggctgcattccaggtgctctcagagctgatgggtgatgtagagattctggaccaggctatggagatagcgccgaacaacagcgcaaggcttgccgtatcctatctccagcagttatatcagctgctgaccctttacggtgtggaggatcacattacatttgacctgagcatgagcgggagctacgggtattatacaggggttgttttccgtgcatatacatacggtaccggcgatgccatcgtgagaggcggacgctatgataaccttctgggaaaattcggagagaatacgccgtcgatcggatttgctatcatcatagacgagctgatgagcgccctgagccgccagaagatcccagtggaaaccagagagatgaacatgatcgtttatacggaggctacgcagaagtgggctatttcgcttgcaaagaacttccgttccaagggcaagtgcgtggagatgcacaagagggataaacaggagagcagggaagcctatgaagcatatggaaaacggatacaggccgtgagtatgctgtatctgaacgatgatctgacgattgagatggtgaatctgcgtaccggggacgagaagctgataaatgcaaggaaaaagagatagaggagcagacatgagatatttaacttttgcccttacaaaagggcgtttagccaataaaacgctggaaatgctggagatgcttggaattacatgcgaggagatgaaggataaaagctccaggaagctaatctttgtcaatgaggagctgaaactgaagtttttcctggcaaagggccccgatgtccccacctatgtagagtatggggcggctgatatcggtgtggtcggcaaggatacgatcgtggaggaaggacgcaaggtgcacgaggttctggatctgggatttggtaagtgcagaatgtgcgtgtgcggacaggaggaagccagggaactgcttcggcaccatgaactgatccgcgtggctactaagtacccgaatattgcaaaagattatttttataataaaaaacatcagacagttgagatcataaaaatgaatggttctatcgagctggcgcctattgtagggctgtcagaagtgattgtggatattgtggagaccggatctactctgaaagagaacggactggtggtattggaggaagtatgtcctctttcggccaggatgatcgtgaatccggtcagtatgcgtatggaaaacgacaggattaaggagcttatcgtgaatctgagaaagctcttacaggagggataaaaatgcgaattgaaaaattagatgaaagtacaaaaaaaaatctgctggaagacctcttaaaacgcagccccaataactacggaaagtatgaggccagcgtccgcgagatactggatgcggtgaaagaaaaaggggacgaagcggtattttcatttacaaagaagtttgacggagcagagatccatgcgcagaatgtgctcgtcacagacgcggaggtagaggaagcctatgcccaggtggatgcttctctgcttgagattatacgtaaatctttaaaaaatatagagtcctaccatgcaaaacagatgcagtacagctggtttgacagcaagcctgacggaacgatgcttggacagaaggtgaccgctctccggagagtaggggtatatgttccgggcgggacggcggtgtatccgtcctcggtattgatgaatatcatgccggccaaggtggcgggcgtggatgaaattatcatggctacacctccgggaaaagacggcagggtgaatccgaccaccctggttgccgccaaggaggctggagcagacgccgtatataaggtgggaggagcccaggcgattgcggcactcgcctatggtacggaaagcattcccaaagtggacaagattgtaggccctggaaatatatacgtagccctggccaaaaaggccgtttacgggtatgtaagtattgattccatcgcaggccccagtgagattcttgtcctggcggacgggacggccaacccgagatatgtggctgcagacctgctctctcaggcggagcatgacgagcttgcatcggctattctggtgacaaccagcagagaactggcagaaaacgtatctttacagatcgatgggtttgtgagagaattgtccaggagagagatcatacagaaatctctcgataattatgggcatatcctggtggcggagacgatggaagacgcgatagacgctgcaaatgagatcgcttcagaacatctggagatcgtgactgcagacccttttaacgtgatgacgaagatccgcaatgcgggtgcaatttttataggagaatacagcagcgaacctttgggagattattttgcagggccgaaccatgtcctgccgacaaacggtacggccaagttcttttcccctctttccgtagatgattttctgaagaaatcgagcatcatttcttattcaaaggaagcgctggaggcagtacacctggatgttgaacgttttgcggaggcagaacagctgactgcgcatgcgaattcgataaaggtgcgatttgaagaatcataaataggattaaaatgggagggatgtatgatggacaggacaggcagctgcatgagaaaaacaaaggaaacagagataaacctgacaatttgtctggacggaaaagggtgcagcaggattgatacgggaattgctttttttgaccatatgctggacggttttgcgagacacggcctatttgacctggaagtagaggttaagggggatctggaagtggactgtcatcatacggttgaggacactggtatcgcgctgggacaggcagtcgccaatgcccttggagataaagcgggaatcaagcgctatggcagttttatgcttcccatggatgagacacttgctttgtgtgcggtggatctttcaggacgcccgtatctgaactatcaggtcgggtttacggtggagaagatcggcgggctggatacggaaatggtgaaggagtttttttatgcggtttcatacagtgcagcaatgaacctgcatctaaaaattctggacggaggcaacaaccatcatatggcggaggccctgttcaaagcgtttggtaaagcactggatgcggctaccatggaagagccgagaatgaaagaggtttggtctacaaagggcagcctgtaaaggagagtggataaatgagttataagagattgaccccttgtatatttattgacggagggaaagctgtaaaatggtttgatgatagagaagtgatcgcggacgatgtggtgtcccttgcaaggcattacggagatatgggggcggatgagctgatcatatttgatctgtccaattcagatgaggagcacgaggaatccattgacctgatgaaaaggattaaccgcgtcatcagcattccgatggtggccggcgggaatatccgcaggcaggaggatgtaaagaagattctctatgcgggtgcaaagcgcgccatgctgaacttttccaagcacctttccatcgacctgattgaggacgtatccaaacgattcggcaaagaaaggatcgcggtatctctgaacgattttgacgcgctgtttaaacagcagcatctgatcgaagagtacagtacggagatcattttcatgcacaggctggatttaaattcggttatgaatgtgacacagattccgtgtgttgtcgtaacggacacgatggaacaggacgagatccttaaaatattgaagtgcgacggcgtgaaaggtgtatcgggcctgtttatcagtcaggcggatatggattttaatgcctttaaaaatgtctgcgctgcggaagggatccggatgacatcttttgaaagcatgatggatttttctgagtttaaattgaattcagacgggctgctgcctgtcattgtgcaggattataaaacgaatgaggtcctgatgatggcgtatatggatgaagaggcctttgaccatacggtcaagtctggcaggatgacatattttagcagaagcaggaaaaaacagtgggtaaagggcgagacatccggtcattaccagtatgtaaagacgatgacgatcgactgtgataaagacacgctgcttgccaaggtagaacaggtcggagcggcctgccatacgggaaacagcacttgtttcttccagccgattgtaggcagtgaatacgacggaaagaatccgcttcaggtatttgaagccgtctattcgacgattatggacagaaaagagaatccgaaggaaggttcttataccaattatcttttcgataaggggattgataagatcctgaaaaagattggcgaagaggcgacagagcttgtgattgcggcaaagaatccgaatcccgaggagatcaaatacgaaatgtctgattttttgtaccatgcgatggtacttatggtggaacggggaattacctgggatgatataacaaacgagcttgcggacagataacatgaatggatccacaacactcctggatagagagttctaactgtttttggcagggcatatgatatggtagacatatcatatgcccttttctgtgcgccctaagggcagcttaacaagaaatccaaaaggaggtacatagattatgaacgaatcagaagaaagacgccgccagcttctaaggcagaccagaaggctttacaatgaggacagctttattcccgctgtgcaccccaggtatggacatatttatcatgacctgtatgacgatgcagaggaaaggcctaaaagcacctttttcttccgtctgacgctgggtgtcttatgctttgtttgttatgtctggatcgattacggcaaagtgaatgtagcaaatgtaagcagcgataaaatcgttaaccagatcgaaaagcagatggatctcaaagatattcaggcagtgtggaaaaagttgtaggggatagacgaaaacccgcgtgctgctgatctgtatttttgccgccgaccagctatattccggaaaatatccgaacgaagaggccgggattacggattatagctcggcagaagtgcagtattctccttactgtaaggcaggagcatctcatactgcccgccgattttagaatcccaataaatagtggcatcgagatccagtgcagatttgagttcctgtatgatatttctgacttctgcctgtgcggtttccggcgataggccgttatgcaaagcaacctggataaaggcgaattgtttctccggaccgtagtcgaatgttacaatagacaagatactgcagaagatatttctgtcggctaaaacgatgcgggaaatctgatcattcattttttcatcctgtcctctcccgatcagcagatccagatgttccacaaaggaggtaatgcccgaccacaaaatcactcccgaaattatgaggctgattatcccgtccagagggagagcggtaagtggagagagcagcagtgatatcatcgtcattacggtcaatgcggcatcagagatactatctttgaacatggcaccgagggcagctgagcctaccttcttatttaaatatttcgtataaaatgctaggcacagcttcagcacgattgccgtaataggaatccaaaataattccgggggcatatccgccgcctggggcttgataatcctcagaaccgcttttttgccaaaagataatgctgcggagatgataaaaaaagaaacaacaaatccactgatatattccattctcccatgcccgttcgggtgatgctcatccgctggtttcgcacacatcttaaaaccaataagggtggcaagagaagaggcacagtccattaaattatttgttgcatctgcaagaacagatacgctgtttccaaggtaccccatggcacacttagcgataaaaagtacggcatttacaaggattcctgcaattccaaccctctgtcctatctgtaggcgggggctgtatttcctatctggctgcatttgtactcctccttctttttctatctgaaaatttatggtctgccggctgtgtcttcccttccggcccgccgccgtgtgccttttctggtgctgctgtcactaaagccattgccgcgtgcgttttgccgcttgtcgcgcatttccgctgtgcgtccgtctaaatgatcgcaggaacatgggttacgctgtgccataaattcccgcattgccctgtgccgttgctcaaagtcctcattcgggaattgttcttcgcatcgtttgataatgcgcccaagataatcgctgaatctgccgagttcctccttctccaggcaatccagaatcacggctgaatcgggcacgctgtcatcaaagcttccggcggctttttcccctttttctgtgagttctataatcatcacccgtttatcattctctgagggatgacgggtgatgaactcattcttttccagtttaagaagcagttctgcaattgactgcttactcatgcccagaagataagtaaggtctctctggctgatttccggcttaatcttcagcatagccaatacacggccctgtcccctgagaggattccggcctctgccgttccccgtaaaagaggcaactgttgtgcgatgcatcagcatctgaagctgttggagctgttctattatcgttgattttaattcgttcatttttttctcctttcctgtaaatcgtgctggatatctcataaaagtcatgtacctgacaaatattagtatagtacctgactattaatttgtcaagtactgtactaaataaattttctaaaaaatctccgcggcaataaattaaattttgaataagaatgttttagagcgtaaaaaaaattgaggggacatataaagtgtccggaaattaaaaaatatgtggtaatagcggcgcgcccggaaagaaaagtaagaaaattttcggaaaagacttgactgtataccagttatacaccctattataaataaaagcattcagataacagaatgcaaccagacgagggggtggatgtttgaatacgaaacaagcggaggaactgaccggaatatccagacagaatattcgctactatgagcggcaggggctgttggaacctgcaagggaaaccggcaatgcatacagggattattcagaagaagatatccggcgtttgaagctgattaagatgctgcggatgctggatatgcccctgaaagagattgagaatgtactgaaggaggagattcccctaaaagaggccgttgcacgccagcaggaaaatctgctgaagcagcagaaacagctgcaggcggcgattgaagtctgcacgagtatccataaggatcaatcggatcaggtggacgtggatgcttatcttgaaaaaatggaaaccatgtcccgaaacggaagcatattcgcaaagattgcggacgattacaagcgggtggccatggaagaacagcagcggaggttttcatttaatgcagatgaagccgtgaacacggccggtatgtttgaggctgtactgcgtaaatatgcatcagaccgcgggatgaagtttcagatggtaaaatccggtatgtaccctatattcacactggacggaaccgtctatacagcggccagagtgctggaggacagtgaggagacaaagaaagcgtcaacacggatactttgtatgagggaaaatgaagagtctatcaagaaagaaatcccggaaaagagaaggagtttttatcagggaatacatacaattctagtaaatatacggcgtcattacaaaaaaagtatcctcaatatcctgatcagcctgctgacggttattgtaatggctctttatctgggcaatctgaccagtacaaaacaacagctcgatgaattaccggaaaggctccctatatcggtacagatctggaacgtgagcggggattccaattcgggcctgttcatacagccgcgggttctcgatgcggtttacggatcctcatacacaaaagagattgtggaaggggcaaagcttttggggcgccttccgcaggagaatgccgaaaacttacaagatctctggattcagggattgaaccgtccggaatgtattgagggcctggaagaagaagatatcaagtggagcgaaggctgggattgggatgcattccagaaaagccaggatgtctgtatcgtgaatcaagcatccatagataaagaacttgggagccagctccccctttcactgcagcactaccagttgctgctttccggaataggattagaaataaaggatctccggcaggtaagtatggaagtcgtcggaatgtgggattccagcggaactgatgaagaggtaaatgtgccggatattttattccctctggatgctgtaaaagagatttataagcagaatgaccagacatattttgcatcttccctgtcctttctggtaaaggattccatgaagctcaatgaattaaaacaggaattaaaggacgccgggtttcagacggtggttccgggctcgactttctcttatgccggggccggggtcagggtagatgatgtgatctttatccggtcggtcactagtctggaaaaaagcctgtctctgctgcagggatttctgccctttgtccttcttgtagtgattatggtggggtatatcgtatcccacttactgcttcagggcagacgggaggagtacgcgattatgcgggcgcttggaacgagcagacgacggtgtacggtactgtttttggcggaacatattctgctggctgcggcaggcggcgctgtgggagcagctacagggttgatattgcggtgggccggcatcggagcaattgcgtctgtctggcttgtgttttttatctgctatatactgggcgcgtcggctgccatgtggatgtttggaagattcagcgttgcagctgtgttatcacacagagattgagagggagatatggaacggattaaagtagaagatgtaagttattcttatcagaataaatttcagacaattgaggcggtaaaacagatatcctgtacgttcgagtccggtaacatgtatgcggttaccggggaatcaggaagcggaaaaagtacttttctatccctgcttgccggacttgaccatcccaggaaaggaagaatcctggtggacggcgaaaatctggcggaaatagaccgggatgcatacagacggaaggaagtgtcagtggtatatcaggcctttcatttatttcctctgctgaccgcctgggagaatgttatgtatccgctggagctccagggaatcccacgcaaaacggcaaaagagaaggcggccctgtgcctggaggaagtaggtctggaagaaaagatcctgaaccaatatccgcgtatgatgagcggaggggagcagcagagagtggcaattgcaagagctatggcagccggtgggaggattctgctggcagatgagccgacagggaatctggatacggaaaatgaagagaatatagtcgaattactgctcagactggcacatgagaaagattacgtggttattatagttacacacaattctttgattgcagaccaggcggatatccgtatgaccatgaaggacgggaaaatgatatcggtagaaaatcagtgaggtggtgtatggcatgacattttattacagcatgaaacaaatgctccgcagtcccctgaagagttttctgttttttcttctgatgggtgtttcggcatttttcctggcactgggtggaaacctctggaacatgagcagaacggcaattcaggaattcgaaaaaatatttaccaccataggaaccgtggagcaggagacaaaggataacgggggttatgggatatgggatgcgaaaatgaaagagtatcagtactttaacgcaagaaccgcgggggagcggatcaaagaggaggtgctggactttgaaggcgcggggtatgtacataagccaaggcagcgcccctattttggagcatatgtagaggagctttatcagggagtggggcgcacctggctgcttaccgtggaggcaacccctctgaaaacagaaacggcggatcattccgtcaagatgcgcattgttaaggtgttggaaggcgctgtcaatgagggggattatatctatgtctgcgaacaccagaatccggaacccagaacgttcgaggcgggaaagacttatattatgcagcttaatcagtacggttttacccacggtgtggaaacagaaaacagcgatagcggggagatggaaattgaatatgttccttcaaatggtaccctatcaacacaatacactctcgatggagaaaggatctatgatcctataaatgaatcaaacgaatttgatgaggtgacggaggggttctacgaaacagaacgcggaaagcgatggctgctggcgggaaatatgcaggactatttggatcatgccataccggttcagcccacagacagcacaaagctgctgatgccgttttatcaggaggaggtcgttatcaccgaggggagggatatcacagaagaggaatatcaggacggcgcaaaggtgtgtctgattcccagtacgctggcaatgctgcttcagaagtccgtgggggacaaactaaccctgcctctgttttatgctaattatcgggatgcaccggtggacaacttttcaacaaagggcagcggatatggattttcctttattaatgcacagggccagccttattccgtattcagcgagcaggaatatgagattgcgggcatctatacaatcaaagattacggtaccggttcccttggaatcggcatgtatgaagtagtcattccctggaacgcagttcccgagaattcctggaaagataacatcgtagcctatggacgcatgcaggttggtaacacgtctttccaaattccaaacggaacaatacagcaatatcaggagctatgggaaaaacaaggggtaaaagatctgaagatcaccttttatgacaaaggctatacccagctccgggaagggattgaaaagcgaaagatgatgtcatggatattcctggtcagcggaggcgtcatggcactcatgattttactgttcttttcaagtatgttcataacgggacaacaggagaggatcgccgtggagcgtctgcttggaagaacgaaggggcagtgttccagatctattctgaccggaatacttgtacttgcggcggctggcagcatcctgggcagcatagcgggatggaaagccacaggagcagccgccaagaaggccgatgcggccactgtattcgatacttcctacagcaatgtgacaacaaatgacacagaggcggacatagagtgggcaagccccagcatcgcactgtcggttggaaccggaggcggtttaattctggcggcgtttatcatctcgtcctgctatatgaaagaaaacctaaaaaaggagccgctgcagcttttagggaagattgaagatgtttaatacgcacagttaatgagcttccatctcgtcggaagatgagtgcgcgaaagaaaggggtagccgttacaggatctatccctttctttcgcgcactcatcttcataaacttaaaacattccgcattttgcttgatgttatgacaaaaagcacttataattaaacggtggtgcccggtgtttccggacaccatcagatcatttggaattaaatagcatggataagaaggatgtatataatgatgagaaaattagcgttgagcgatgagatattgctgaatatcgagaaacctgcccgttacatcggcaatgaggtaaatgcagtgaataaagacccggatcaggtggacattcggtttgccctttcgtttcccgatatcatggaaattggcatgtcccacctggggattcagattttgtatgatatttttaaccggcgtgaggatgtatggtgtgaaagggtatattctccctggaccgacctggacaaggtgatgagggaacagaagatccccctgtttgccctggaatcacaggatccggtcaagaattttgacttcctgggcatcacgatccagtatgaaatgtgctacacgaacatactgcagatcctggatctaagccagattccgctccacagcgcggaccgtacctgggagcatccgatcgtaatcggcggcggcccctgcacctacaatccggaaccgctggcagagttctttgatctgttttatataggagagggagagacggtctatgatgaactgctggatctctacaagacctgccgagccgggaacagcagccgtacagagtttctgagaaaggcggcagggattgagggtatctatgttccgatgttctatgtagcggattatcatgaggatggtacgctgaagtcctttacaccgacggagcccgggattcctgccacggtgaaaaagcagattgtaatgaatgtgacggaagcgccttatccgatgaacccggtggtgccctttatcaaagcaacgcaggaccgggttgtgctggaaatccagaggggatgtatccgcggctgcagattctgccaggcagggatgctgtaccggcctacccgcgagcgaaacgtggagacactgaaggagtacgcccgtgttatgctgaagaatacgggacacgaagagatctctctgagttctttgagttccagtgactattccgaactgaaagaactggtggaatttttaatagatgaatttaaggataacgggatgaatattaccctgccatcccttcggatcgatgctttttcgctggatgtgatgcagcgggtgcaggatgtccgcaagagcagcctgacatttgcccccgaagcgggttcgcagaggatgagaaatgtaattaataagggcctgacggaggaaatgatcctggagggggccggacaggctttcgagggaggctggtccaaggtaaagctgtactttatgctgggccttcccacggagacggaagaagatatgaaggagatcgctaggctttcagaccggattgcgagaagatattacgagatcccgaaggaggagcgccatggcaaatgccagattacggcgagcacttccttctttgtaccaaaaccgtttaccccattccagtgggcgcctatgtgtaccagtgaggagtatatgcacagggcttcggttgtgaagcatgaattccaggagcagttaaacagaaaaagcatgaagtacaactggcatgatgccgaagtaaccgttctggaaggcgtatttgcccgcggcgacaggagagtggggaaggccattgaggaggcctacagactgggatgcctttttgacgcctggacagaaacattctgcaatgaaaaatggatgcaggcttttgagaatacgggcattgatgtttcattctatacagcccgggaaagagaactggatgaattgcttccttgggacttcattgatatcggggtcagcaaaagttttatgaaaaaagagtgggagagggcgctggagggcgttgtcacaccaaactgtaagatgcagtgctccggatgcggcgcggcacaatttggaggaggtgtctgctatgaaggtaagaattaagttcagaaaatatggtgcgctgagatttatcgggcacctggatgtgatgcggtttttccagaaggccatgagaagggcggagatcccgatcgcctttaccgccggttacagtccccatatgattatgtcttttgcaaatccgctggggatcggactttccagtgatggtgaatactttgatattgagctgagcggtccgatttccagcaaagaggcagtaagacggctgaatgaggccatggtggaagggatggaagtcgtaagcttccgtcagattgcggaagaaaagaagatgactggaatggcgatcgttgcggcggcagattacaggacgacggtgaaaaagggtgtgtttcctgcggattgggcagagaagattgcggcatttatgacgcagcccgagatccggattctgaaagagacaaaacgcagtgcaaatgaagtggatatcaagccaatgatataccggttggaagcggaagcggacactgtctgtatgcaggtggccgcggggagcgtccagaatctgaagcccggccttgtcatggaggccttctgccattttatggggattgattttgccgagagcgattattcacatcacaggcttgagatgtatgcggataggggacaggaaggcagacgggaactggtaacactagaagatctgggtagtgaaatggagatggaaacggcatgacttcaagaaaagttcttatgatgaaggaggcccaaaaggtctggatatttcttctggaggacgatgaaatcgtagaaatacactgcgataagccggacagcggcgtaaggcagcatgtactcggcaatatctatgtaggcaaagtgaggaatatagtgcccaatatcggagcagcatttatcgagattgagagcggcgtggaatgttattatgacatgagccaggccgctaatgctctgtttactcataaagcaggcaggaagccgctctgcatcggggatgagctggttgttcagatcagcaaagaggccgttaaaacaaaggccccgactgtcagcagcaatttaagctttacgggcaggtatgcaatcctgactaccggaaacacaagaatcggaacctccggcaaacttcccaaatcgctgcgtgaggaattaaaagaacgcctaatgccctataaaaacgaggagtatggtcttatcatccgtacgaatgcaggcgatgctgattttgcccagatcctgggggagattaagagcctggaacaaagctataccgctctgaagtctgcggctcagacgagaacatgcttttcctgtctgcaggaggcgcctcccgcctatatctctgacctgaaaaatgtgtataccgaaggtttaactgagattgtgattgaggacgaagagctttaccgccaggtcaaagaatattatacaagagatcagccggcagaattagaaaaactgaggctttatcagagcagccagcttcctctcggaaagctgtataatacacagactgtactggaaagggcattgagtgaacgcgtatggcttaagaacggggcctatatagtgatacagtatacggaggcactgaccgtgatcgatgtgaattccggaaaatgttctgtaaaaaagaatccttctgaaacctatttgaagatcaatctcgaagcagctagggaagcagccaaacagatgcggctcagaaacctttcgggaatcgttattgtagattttatcaacctggatgatgcagatgcaaccagggaactgctgaaaacattccgccagtacctctcaagagatcccattcagtcaacacttgtggacgtgactgagctgcagcttgtagagctgacccgcaaaaaagtacgcagacctcttcatgagagtttagctgaataatttttttagtttttatattgtataattgtatgtaatataagcctatttgtagtacagaatatggctagagtggtgttgaaagaaaaaatattgcattcatgtatacaatatttgaaactagtgtgttgtgcagaaattttaaggtggtgaagttgcaaataaattgtatacgattatacaatttatttgccgaaaatgttaccgcagcaaaatgcctaatgttacaatagccagaaaaccatggctttagtataataagtgaacctctccggtcaatcaactgccggggagttccaagaaaaggaacatcattatggaatatattccagctaaaacgataattactcgttcaaaaagaccagaatactggtttggaacagaatataatatgaatatatataaaggatgctgtcatgggtgcatatactgtgacagccgttcagactgctatggaatctcttcctttgacactgtcagggcaaaggaaaatgctttgatgatcatacgcgatgagctgcgcagaaagacaaagaagggcgtgattggtacaggggcaatgagtgatccttataatcccttcgagaaggaactggaactgacccggcatgcgttggagctgtgcaatgcatttggtttcggtaccgctatcgctacaaagagcagtctgctggcaagggacatcgatgtgcttacagatatcatggaacattcaccggtactatgcaaagtcacaataaccacctcggacgatttgcttgcaaaaaaaatagagccagtaccgccgccgtcctcggaacggtttgccctgattcgtgaattggccgatcatgggatatatgccgggattctgttaatgcccgtgcttccgttcctggaagactctgatgagaatatccgggaaatcgtttgtaaggctcacgaggcgggcgcaaaatttatctatcctgcttttgggatgacgctgcgggaaaatcagcgggattggtactatgaaaagctgaaccagctctttccgggagaggggcttgcagagaaataccaaaagagattcggcaattcctatgaatgcagaagcccgcgggtgcgccagctttggaaggttttcgagaaagagtgccaggaggcggggatcctgtataagatgtccgatatcatttcaagctataagcgcccctatcgtatggagcagctcagcttattcgattattgagtaaatcatgtgcagaatgtaatggttcaggctctgccaatcctgcaggagacaaaatataacatatagggagaagactatggggaagaaagaactgaagacgaatgcaatgcggatattggaccgatataaaataccttatgaatatcagacttacgaatgcgatgaattcgtggacggcattacaattgcaaaccaaacgggcctgcctcatgacagagtctataaaacactcgtaacaacagggaagagcgggatacattatgtgtttgtgattccgattgcgtctgaactggacttaaagaaggcggcccgttctgcgggagaaaagtctttggaaatgcttccggttaaagagcttaccgcggttaccggatatgtcagagggggctgcactgccattgggatgaaaaaacctttccctactataataaatgaaacggcccggtgcctggactacgtgtatgttagtgggggcaggctgggcgtgcagctaaaactggctcccggtgatctgaaaagggcctccggcgccgagtatgcagatgtgatactttaaatttgcagaaaaacagattttgaatttgatttatgaataaaaatgcaggattttttgtcataaaatgcaaaaaaatgcgaaagaagagatttacaaccgggaatgactgcgttataataatgtaccgagaacgcagaaattttgaagagggaactatatcgcacagtatttgctgttaaaggccggatgcatgccggatatgggcgcctctttatgtatattggaggaaacgaggaatgaaaaaagtagtaaaattcggcggaagttctttggccagtgccgagcagtttaaaaaagtaggggacatcatacgggcagatgaatccaggcagtatgttgtaccatccgcaccaggtaaacggttctcaggtgataccaaggtaacggatatgctgtacagctgctatggggcagccattaaggaaaagaactttacagacctgctctgtgcaatccaggacagatataatgagattataaaaggactgaatctgaccctttccctggatcaggactttgaagagatccgtgaaaatttcggaaaaaaggccggaagagattacgctgcctccagaggggaatacctgaacggcaaggtgatggcggcatatttgggatttgaattcgtggatgcagccgaggtagtccgttttgacgaggacggcaattttgatgatgctgcgacaaatgacctgctgtctgcacgtctgaaagagattccgtacgctgtcattcctggtttttacggggcgaaagcagatggaacggttgtaacattttccaggggaggttcagacgtcacaggttcactggttgcgctggctgtaactgctgatttatacgagaactggacagatgtttccggatttctcattgctgacccaaggattgtgaagaatccgaaatccatagagactattacatataaagaactgcgtgagctttcctatatgggggcgagtgtgctgcatgaggatgctattttcccggtaagaaaagcaggaataccgatcaatatccgcaacaccaatgcgcctcaggataaagggactttaatcgtagagggcacatgcaggcagccgaagtatacgattacgggaattgccggtacggacggcttcgcatccattacagttgagaaggcgatgatgaactctgagattggtttctgccgtaaggtgcttcaggtattcgaggagaatgagatttccatcgaacatatgccgtcgggtattgacacaatgacaatctttgttcataaggatgaattcgaggaaaaggaacagcgggtgcttgccggaatccacaaggccgtagatcctgaccacatcgaactggaatcagatcttgcactgattgctattgtaggccggggaatgagggcgacacgggggacagccggcagaatattctctgcccttgcccatgcgcacattaatgtaaaaatgattgatcagggatccagtgagctgaatattattgttggtgtcagacatgacgattttaaaaacgcaatcagggcgctgtatgaaatctttgttttgacacaaatttaaggaaaggtattcattatgaacattctgttttttttaaaaccgaaaaatgaagttgcttatatctacaatgacagtacgctgcgccaagttctggagacaatggaataccataagtatgcgtccatccctatgctgaacagggaaggggaatttgtcggcactgtcacggaaggagacctgctttggggaataaagtcgtacaataatctggacattaaaagcgctgaacacatcttgatccaggatttcccacgcaaggcaaattttgatgtagtgcctgcggatgccgatatggaagatctggtgaagaaagcgatgaaccagaattttgtacccgtagtggatgaccagaataagttcatcggaattattacgcgcagaagcattatagaatactgctacaataaactcaatgattgtgacaagtagaagccttcccaaaggcttaaataaggtaaaataagatgatagattttcatacacatatttttccggataagattgccggaaagacactggaatttttaagcggaagatgtaaaacggttccctttaccgatggaactgctgagggtctgagggcttccggggagaaagcgtgcatagacatttccgttgccctcccggttgttacaaaaccgtctcagtttgacagcataaaccgttttgccgcccgatttttggagggcggcgtgatctccttcgggggactccatccggacagcgcagactacagggaagaacttaagactttgaagaacatgggatttcaggggattaaactgcaccctgcatatcaggagacgatgtttcatgatatccgttataagcggatcgtttcctatgcatcggaattggggctgattattaccgtgcacggcggctacgatcccggatatccggactgtgtttactgcacgccgcagatggcggcagaggtgattgacgaagtgcagcccgaaaagttggttatcgcccatatgggcggttttaaatgctgggacgacgtggagcgctgcatcgtcggaaaaaaggtttatctggataccgccgttgtatttggttccatcgatgacggacagtttgtgcgtatttgcaggaaccacggcacagatcgtattctttttgccacagattctccatggtccgggcagtcagagtccatagaatatatgaatagacttccactgacacaggaggaaaaaagcaggatttttgacgaaaatgcccggaaactattgactttataaatttgtatatgctatactacaacggtatgccgcgcaatgaggttctgaagttctgcccttttagcagacaccgtaattggcgagtaatgataataggaggtgccatatgtacgcaattatagcaacaggtggtaaacagtacaaagtagccgaaggcgatatcattaaagtagaaaaacttggggtagaagctggagagacttatacatttgaccaggtacttgcggtgaacaacgataaacttgttgttgggaacccgacagtcgaaggtgcaacagttacagcttctgtaattggtgacggcaaaggtaaaaaagttgtcgtttacaagtataagagaaaatctggataccataagaaaaatggtcacagacagcagtatactgcagttaagatcgacaagatcaacgcataacccggtgagagaatgattaaagtaaccatttataagactgacaagcacgaatatgtaggttttgacgcactgggacatgccggattcgcggatgagggcatggacatcgtatgtgcggcggcttcagcgctgattatcaacacgataaacgcggttgaaagatacacatccgatgagacgtctgtagtgacagacgattcggaaggtgcacaggggctgattcagttcagatttaccggtgggagacctacacacgatgctgaattgctgttaaagactatgattctggggttggaagaaatagaagatgacagcgactatgaaccatacattgatattatcttcaaggaggtgtaataaccatgatgaaattgaaccttcagtattttgctcataaaaagggagttggttcttctaagaacggccgtgactctgagtctaaacgattaggtgccaaaagagctgacggacagtttgtaaaagcgggcaacatcctttacagacagcgtggaacaagaattcatccgggcgtgaacgtaggacgcggcggggatgacacactgtttgcattagtagacggagttgtcagatacgagagaaaaggaagagataagaaacaggtttctatctatcctgtagctgaataattagttacggtacacacggcctcagacctaacagtctggggcttgtttattatttcacatcgaaatgcacaggcaatagctctgagcagggatttctttcatatttctttgaactgttacaaatatgcagctataggatatgtgatttcagggaattatgaatagtaaaaggaaccatcttgtgatataatagtacggatatggaattggtaaaaatagtaaatagaaaaggatatattatatgtttgcagacagagcgaaaatttttataagatccggcaaaggcggtgacggacactgcagctttcggagggaactctatgtaccgaacggcggaccggacggaggggacggcggaaaaggcggggatctggtttttcaaatagatgaaggcctgaatacgcttgtagatttccgccacaaaaggaaatatgctgccggcgacggcgaagaaggcggtaagcgccgctgccacgggaaagatggtaaggatctgatcttaaaggttccggagggaaccgtgatcaaagaagcaaagaccggtaaagtaatcgcggatatgtccggggacaaccgcagccaggttgtcttaaaaggcggcaggggaggactggggaatcagcattttgccacatccaccatgcaggtaccgaagtatgcgcagcccggacagccggccatggagctggaggtgaatctggagctgaaagtcatcgctgatgtagggctgattggttttcccaatgtgggcaagtcaacgctgctctccagggttacgaatgcggatcccaagattgccaactatcattttacgacgctgaacccgaatctgggagtcgtggacctggatggggcgaaaggattcgtgatggcagatatacccgggctgatcgagggggcatcggaaggcgtcggacttggacatgagtttctgcgccacattgaacggacaaagatgatgatccacgtggtggatgcagcaggaactgagggccgggatccggtggatgatatctataagattaatgcggagctgacggcttataatcctgagattgcagagcgcccgcaggtgattgcagccaataagacagatctgatatacagcggggacgatgatccggtggacaggctccgggctgaatttgagccaaaaggaatccgggtattcccgatttccggagtttccggcaaggggattcaggagttgttatactatgttagcgggcagctccaggctatggatgagaagccgattgtatttgaacaggaatactttcctgaggatgaactgatctatgaagacctgccctacacagtggagagagaaggagaactgtttgtagtggaaggcccgaagattgaaaagatgctgggatacaccaatctggattccgaaaagggatttgccttcttccagaagttcttaaaagattccggtatcctgaatgatctggaacaggcaggcattcaggagggtgacacggttaagatgtatggactgcagtttgattattataaatagacaggagataaaacagtatgacaacaaaacagcgagcttatttaaaaagccttgccatgacaatggatccgatcttccagatcgggaagtccagtattactcccgggcttacagaagcaatttccgaggctttagaggccagagaactcatcaagatcagtgtgctccaaaattgtgcagatgatccaagggagttggcagatctggtggccggcaggacacgttctcaggttgtccaagtaatcggcaagaagattgtattatacagggaaggaaaagacgacaagaaaaagatcgtacttccgtaggaggattttatgaaaatcggcatcatgggaggcacattcgacccgattcatattggtcatctgctattgggagaatttgccttcgaagagtttaaactggatgaaatatggtttttaccgaatggtaatccaccgcataaagatacggaagagatggatacctcgcttacccacagaattgagatggtaaaggccgcaatcagcggttccccgcattttaagctttccatgcatgaggcgaagaagggtatatcttacacgtatcggacaatgcgtgatttccatgaactgtacccgggcaacgagttttattttattttgggggcggattctctgttttctattgaacaatggaagtatttcaaagagatttttccaacctgcaccatactcgccgcgatgcgggatgacaaggatgtgcgagatatgcagaaacagattgcttatcttaaaaagaaatatgaagccgagattgaactgcttcgggcgccgcttctggagatttcttcaacaacgatccgggagcgggctgcgaaggggctgacagtgcattatttcgtgccggatgcagtggctgattatattaaagaacatcatttgtataaggaagtggagcaatgacggagattttggggattcgaagaaagttggagaagagattaaaaccagaacgctacgaacatacgctgggagttatgtatacggctgcatcgcttgccatgtgttatgaaacggatatacatcaggcgatgctggcggggctgctgcacgactgcggtaagttctgctccggtaaggagcagatcaaattgtgcagggactgcaatatcgcactgaccgagtctgaactgaaaatgccggccctgatccatgccaagctgggagcatatcttgcggagcatgaatataatattaaagattctgatattctgggagccatcacttatcacaccacgggaaagcctcagatgacactgcttgaaaaaattatttttcttgcagattatattgagccaggtagacagggaattccggttttaaaagaagtgagaagagaggcgttttcaaacctgaacaaggcagtggcacttagtgctggttcaacgatttcttatctgaagaatgtgggcagggagattgatcctatgaccgtcagaacttatgaatattatcagtagcagttcagacaatcagaacggttgctataatcatacaaattaaagaagtaaaggagactgatttatggaacaagcaagggaaatggcgcggcttgcctgcaaagcgctggatgaaaaaaagggcgaggacattaaggtgatcgatattgccagcgtctccgtacttgcggattattttatcatcgcaaacggcagcaatgagagtcaggtaaaggctctgatagacaatgtggaggaatgtctccacaaggcaggctttgtgttaaagcagcgggaaggctacggaaccgccagctgggtgctgcttgactttggagatatcatcgtgcatatttttgataaggagaacaggctgttctataacctggaacgtatttggagggatggcgtagaagtagatgttgaaacactataagcgccggtggaggatattatgaggaaacgagtgtataaaactgcagtctgcctatttacagctgccattctcagcttgacggccgggtgctcttctgcagaagaaaaaatgaatgataacaagaaggaaagcctgctggatcctaagaagccggtgtctatcgaagtatggcactattataacggcgcacagcaggatgcctttaatgaactggtaacagagttcaatggcagccggggaaaagagctgggaatcaaagtaaaagcatcaagccttggcaatgtggccgatctggaggataacgtactggcctccattgacggaaaagtaggggcaaaagaaatccccgatatttttgcggcttatgcggatacagcctatgcggtggatcagaagggcatggctgtggatttgatggaatatatgactgaagatgagatcagtgaatatatggacagctacattgatgagggaaagttttcctccgaagacagcctgaagatattcccgattgccaaggcaacggaagtatttatgctgaacaagacagactgggataagtttgccgatgcaacgggcgctgccctggaggatatttccacaatcgaggggattactgccacatccaaagaatattacgaatggacggacagcctgacagatactccggatgacggaaaagccttctttggaagggacgctatggccaattattttataataggagcacgggaactgggaactgagattttctctgtcaaggatggccagccggctttgaattttgataaagatgttatacgtaagctttgggacaattactatgtgccttttatcaacggctactttgcttcctccgggaagttccggagtgatgacatcaagacagggaatatacttgcattcgtaggttcctctgcgggtgcgacatttttccctgatcaggtgacgctggacgatgaaaatacatatccgatcgagatgcaggcttttgagtgcccgcgttttaaggacggcgggaaatactctgtacagcagggggcaggcatggtcgtgatggaaaaggaagataaggcaaaaatcgaggcttccgtggaatttttgaaatggtttacagacactgaccgtaatatacagtttgcagtgacatcagggtatctgcctgttaaaaaagaggccaatgataaagaactgatcaaaaagaacatagacagtacagacagcagcgtcatccaggtgctggaggcttccctaacacagattgaggaaacttcactctataccacccgcgcctttgaaaatggtacggatgcccgtaatgtactggagtattcgctctcagacaaagcggcagcggacagggcagaggtagaagcagccatatcagccggttcttcaagggaagaggctgtcagtaaatataatacggatgataattttgagagctggtatgaggagacactggcatctcttgagaagttagtagataataaataaatccggtaccgttgaataaatataggaagcggatgaaagaaaggagggcacgggaatgcaaatcaacagacagaaagcacagcctatactgaaaagaatgctgattcccatggtcctcctgactttaatagaagtaatgctgctctcaggaacttttatatttgggggagccattcaggaacttgatgagaatgccaaaggcattgtacagggaaaggtagccaaccgttccagctacttgcagaatgagatgataaacagctggtctaatgtgtcttatacggtacaacttattaacgagaccgctgaaaagctggatcatgacgggacgatcgacctggataatataggaaaaaactcaaatgcctgctttccgctggtctctgagatttctggaaatctgatcgaaatgcttcgttccaataaggtgaccggagcttttgttgtttttaacaatgatgatcccaaagaactgagggaacaggagagtttttcccgtccgggcgtttatttccgggatctggatccggatacaagcgtctctgtccgcaacagtgacctcctgattgagagaggctcggttgatcttgtacatagcctggatatagccactgacagtgcttggaagcctcagttcgtatttaccagggaacatgaggaaacatataatctttttctgaatccgcaggaacaaggatatgaaaaccccgaggcagcttcgttgacagaattgggatattggggaaaaccccatacgcttacggacgatgataagatgatgatttcctatacggtgccgctgataactggaaagggtaaagtctatggtacacttggcatggagattacactggattacctttccactatgcttccgtccgaggaattgatggaagataagccggcctcgtatttattgatcgttcaggatgcaaaaaccaatgaatacagaaccgtatattcatcggacagcagcatcgcaccggacatggaaaagctggatgtatcacagtcatctgatgggaacttttattttaacggtacagaccatgagcggtattttatggatatggaatatttccagctctatgattcgaacggcccctttgaatcggatcgttggggactggcaggtgcagtaaaagagagtgatcttaccgagttttctaaccatatcatgtcctatattattgttgcaattattctgacaatcattatgggaatcgcaggcagcgtgcttgttagttttatgatatcaagaccgatacatcttgtgtcaaaacatatgcagcagatgaatagaaaaagcaaaataggcctccctagaacgaatatatatgaattcgatcagatggaagagtccattgagaagctgagccgtgatgtaatcgattccgccacaaagtttgcgcagattctgaacaaagccagcatacgtatagcagggtttgaaattgacatggataatagaactctatttttgacggacggtttctttgatatttttggccttaagggttccattgcttcgaatatggatgtgcagacttttatcatggaaatgaaggagttggatatctataaagcagaggaagcggaagactatatattgtataagataccggacggggaaaaagagacctatgtccgcctaagttattcgggcttggaggatcgaagggcaatcggcatagtagaagatatcacgaagacaatacaggaaaagcagctgattgagcatgaacgtgatcatgatctgcttacagggctgaagaacagacgtgcattccagcgtatcatgcagcagctttttgaaaagggagaatcctgcctaaagaaggcggcactggttatgatggatctggataatctcaaacagatcaacgataagttcgggcatgattacggggataaatacattcaggctgcggcagacagtttccgtaagtatacgccgtcgaacacaattatatcacgtaattcaggggatgaattttatctgtttttctatggatatgattcggaggaggatatcacacggattctttccggcctgaaaaagggcatcgacgaagaatacattttgcttccgccaatgcagaggctcaaaataaagatgtccggcggtatctcatggtatccaagggattcccgccattacgaacagctcctgcaattttctgatttcgcaatgtatcaggtgaagcattctaccaaaggcgaaatcagtgactttgacctgggggcatatcacagcgaggagtatatctcgcagaaccgcagggagctttcggaactgctggaacgggaaaaggtagagtactattttcagcccatcgtcgatgcgcacaccggcaggatttttgcctatgaggctctgatgagaggaaccatgcctacattgcgcaacccttcggaaattctggctctggccagagaagaacacaaactggataaagtagaagaactgacctggaagatggcatccaccacatttgtacagcatgtgaagaaccaacggattaggcctgactgtaaagtctttattaactcattggccgactacagagtgagtaacaggatgattgagtttattgaatctgaatgtaaagggtatctggaccacttcgtattcgagattactgaatacgcagaggcagataaggaggctatggatgtaaaacgggttcttgtcaaccgctgggattctgattttgcgctggacgattacgggagcggatataatggtgagagaatccttctggagcttgcccctaagtatattaagatcgacagagagattatatccggtattcatgataatattgataagcagaagatcgtggaaaataccatatcttatgctaaggaaagaaatattaaagtcattgcggagggaatagagacggaaaaggagatgcataaggtgatcgaactgggtgtagattatatgcagggatattaccttgcacggccatttctggaaccgccgcagataagcgaatatattgtggaacagattaagaaagactgaatggagcgaaccgcctaccggtcggcgggattcccgcaggagataattaagaggataaaaaagacatgcgcatctttattttgcgcatgtctttttaataccaatcggaaatcccttttctgcctccggatcttaaaaaaagcggaaaaccccgatcacttttcctaagatggacacttcttttactatgataggctccatgtagtcgttctccggctgcaggcggtataccccctcttctttatagaaggttttgactgtggctccgtcttctacaagtgcgaccaccatgtcaccgttggaagcggtatgatcttgttcaacgagcaccatatcgccatccaagatcccagcattaatcatgctttctccttttacagtcagcatgaaggtctgcttgttgggcatgaattccataggtatcgggaagtagttttctatgttctcctgtgccagcagcggctctcctgcggcgacacggccgacaagcgggacattcacaacttcgcgtctggtcagattaaatgtatcatctaatatctctatggctctgggcttcgtggggtcacgccttatgtatccgttcttctccagtgtctcaagatgagagtggacagaggaagtggactttaaactgaccgcctcacaaatctcacgtacagcagggggaaatccccgttctaatatctgtgcttttatgtattctaatatctccagctgctttttgctgatcttaccctgtgacatatagccctccttaatccgttaaagccaacgctcaactcattctataaatatagtatcatagttatttttaaaaagcaaacacttgttacgaaaatatgttcgaaaaatgttgtgtgagtattgacaaacatgtgttcgtgttatataatttcaactataaagaacaaacgttcggaaaacggataaaaaactaattattagggagttttaaggggggaattactaatgcagagagaaagaaattatgtaaaagcacggactatcacaaagaacgggagacatatcaggagtatgctggttctatttattgcaacagtattcattgtatttgcggcatgcgctttgtttggaaaccttttgatttcagcacatgagaaacattcagaacagcctgttaacttcaagtattacaagagcattgagattcagcccggagatactttatgggatattgcagaagaatatattacagaagattatagttccgtttcagaatatattatggtgttaaaagagatgaattcgctgagtacagatgatattcaggcaggccagaatctaatgattacttataacgatacagaattcagagataaataataaacattaaggaggaattttatagagaaattagataatggtatcaatatacatccctatgtattgatatataaactcacccagagacagcccgcacttatgtacgggctgtctcgtttaaattatagaatagaacgggggaaggagtttattgttaccgttaaaacactatttaataatcaagggatattgtatgagatagattaatctatacgacaaatactgatttttccaatagatatggacagagatccgcatccatggtataattacctcaactataaggggtttttaacattaaggaggaattttaacatgtccgcacaggatccgaaaacatatcatgaacagacttacatagacaataccctgcgtctcagggaaattcttaagacaatgccgccatttgtcagggattatttccgtgctatagaacctaaaagttctgccaaaacgcggatatcttacgcctatgatatccgcgttttcttccattttttaatggagaataatcctgtttataaagactataccatggatcagtttaccgtgaaggatctggagcgcatcgagccggttgatattgaggaatatcaggaatatctgaaggtttacacaggctctgaggataaacaaattacgaatacagagaagggactggcgcgcaagatgtcagcactccgcagcttctatgcctatttctttaaacatcaggtgattgagaagaatcccactttacttgtggacatgccgaagttacatgataaggctattatacgtatggatacggatgaagtggccgctctgctggaatatgttgaacacggcggcgatgacctgaccggtcagcgcaaagtgtattttgaaaaaacaaggaaccgggatctggcgatcctaacgctgcttttgggtaccgggattcgtgtatctgaatgtgtggggcttgatatccaggatgtggattttaagaacaacggagttaaggttacccgaaaaggcgggaatgaaatggttgtttactttggtgaagaggttgaaaatgcactgaagatgtatctgtatacaactagaaagtctattactgcactccccggccatgaaaatgcattgtttctatcaacccagcgaaaacggatgggggttcaagccgttgagaatatggtgaagaagtacgcacgccagattacgccaaataaaaaaattacgccgcacaaattgcgcagtacctatggtaccgccctgtacaaggaaacaggtgatatttaccttgtggctgatgttttaggacacaaggatgttaatactacgaaaaaacattatgcggctatcgatgagaaccggcgcagacaggctgcgggggccgtgaagctgcgggaaccttaatatctaagttaaaacagcgctttgccacgaatctaatgacaaagcgctgttccgcttcgcattattcaaaccatacatgcccgtgatcgccaagcagtttgtctgcggctttcggacctgcactcccctgagggtataaatgtactggaagaccacttcgatgatactgctcccggatcgcatccacgtatttccagctcgtttctatctgatcccactgggaaaaccaggaacgctccccacggatacatgcaccaatcagtctttcatatgcctcgggtgtattcatctgattgatgaaggaacaattctggcagaagtccatttttgcctgaaccacttcttctgattccccgggtttctttatattaaactgaagatatacgccttctgtgggctgtattttaatattcaatatatccggttccactcccggcacagggcttttaaacacgactgcaacctgcatctcccgcttcccaagcttttttccggtgcggacatagaatggcattccattccaacgttcattctctatcatcagacggactgctgcgtaggtctccgtgacagagtccgcatcaacagcaggttccccgcggtagccctcatactgtcccagaacaatattctcttttatatcttcaggcatatggagcgcgttcaggaccttcatctgctcccggtgcatatcttctgcagctgcactctccggctgttccatggctacaatggtgaggatctggaacagatggttctgcatcatatccttcagagcgccgctgtggtcataatacccgcctcttgtctccacacccatctcctccagcgcagagatctgaatgcagtctatatgccgtgcattccagacattgctgaaaattggatttgcaaagcggatagtctgtatatttctgaccatctcttttccaagataatggtcaattctataaatctggtcctgtttaaagaaagtctccatcgtcgcatttaaactcgccgctgccagaagattttcgccaaaaggcttctcgatcacgaccttgccattcccggcgccggataccagctggagcccttttacgataatttcaaagaacctgggagctactgcaaaataaaagatgtgctcaacatctcccattccccggtaaaatgcatccagatcaacatatgctgacgcatcggtgaaatccatacggtagtaagtcattttctctgcaagcttctcatagatctcttctttatacccgagtcttgcgaatttttctacccacctgcgggccatctcccggtattccccactcgtgtagtctcttcttccgatgatgacaatttgtgtgcaaaggtccttgtttttaaaagcctccatattataaaatgccggtatcagtttgcggaatgtcagatctccggtacctccaaagattgtaaaaatttgttctttacacatattaaaacctccaatcgtgatggaagattcctcccctgtcagtccgcttgtaggtatgtgccccaaagcagtctctttgtgcctgaataaggttcgcacccactggcattcccctgaaagcatcgatatacgccacagcctggctcattgccggcagcggaatccccttctgaattcccatgcacatgatatcccggagacttctctgcccacggttcacaccttccatgaagaaggaatccatcatcagattcttaagcgctccatttttctcaaacgcccttgtaatatcatccagaaattgtgcctgtatgatacagccggcacggaaaattgatgcgattctgccataatccagatcccatccatattccccggatgcatgggaaagcagttcgaatccctgcgcataggctgcaattttggctgtgtacagcccttctcttacctgctttttaaatgctgttttctcaggagccggctttggttccgggctatcgaacaaatctctggctgtcttcctctcctcaatacggttcgacataatcctggcattacatgccgctgttatcatggatacgttgacaccctgtttcagggattccaggctggtccagcggccggttcccttctgccctgcactgtccagaatataatccaccagctctttgtctgtaaaatcatctttctcccggaagatacctgctgtaatttcaatcagataactcttcagttcgccttcattccactctgcaaatgtatcggccagctcttcatttgtaaagccgcctgcgtatttaaggagcagataagcttctgcaatcagctgcatatctgcatattcgatcccattgtgtaccatcttaacgtagtggccggcgccgtccggacccatgtaggcacagcatggctcgccctgtgcttttgccgcgattgcttccaggatgggggcaatatggccgtatgcctctttgtcccctcccggcatgatagaggggccaaaacgggctcccttctctcctccggaaacgccagttccaaaataaaggattcctttttcacgcaggtttttctcccgtcttcttgtgtcttcaaagaaagagttcccgccatccagaatcatatctccctcatcaagaagcggaagtagctgctcaattaccatatcaacaggctttccagcctttaccataatcataaactttctcggacgttcctgtgatcctacaagctctttcatatcgtaaaaaggaacaaagttctcatgcggatgctctctgagaagttcatcggtcacctcccggcttcggttgtaccctcctactttaaatccatggtcagccatatttagggcaaggcttcttcccattaccgcgagtccaatgactcctatttctgttctcctcatcgaaatacctccttatcatcaatctatcgttgttatgccagtacaagcgataccccttccggcatctctacacggctgcgtaccccttttaattttcctgtttcacagtcccgctcgatacatacaattccaccttccaggcggtttgccacaagcagaaacttttcatttttgcttaaaataaagtcacgcggatgtttcccgccacaggatacatgctgtatgacggtggctttgtcatgacttacatcgatagctgccagcaattctctttctctcactgatatatatagaaatttctcatttttcgtcagccggattgccgccgctgcagccgcccggggctgctccccggtctttccgcttttggggagaatagaaaatgtctgctccagcgaaaactctcggccgcaaactttaaaaataaaaagttcattactccattcactcacaacataaagcctggtgtgagcccgattaaaaacaccgtgtcttggaccgctgcctttgggaaagctgatctctccagcaggagcaaatcctctttctttgtcgaagaaccggattctgtcctgcgtaaggcagggtaccataacatacgagtcatgaagcagtatctggtggcatccggcgccctctccattttcaatccgcttcacgaccacaggcttttcctctgttgtctgatagatcattacggtgccttcatggtagtttgctgtatagataaagtcttcctcctgttcgatgtaacaaggcgtctggcgttcctgcagcacctcgccggcgcactttttcaccgatccgtgatttagttccagaaaacaggttcccgccattcctcccttttcgtcaggaatgaccatccgatgactgcttaaagaaatccatttggaattccttgcctcataaaaaagttcaggtgcggtcaattctccagtctcttcatgaaaagaaaaacgatatatccctctgctctcctctgaataatatgtcccgatatatccatcggtaaaaccggctgttgtttctttttcttttactttctccataatgccactccccgattctgattattttattttagaattcgtagtatccctcttattgttaactgtaattatacatattacagttaacaatgtcaaatacaatttatgatattcttcattattattcccaataaaagaaaaaattccgatctacaactagaatatctcttctcgaccaatattagctacaatatttttatcatttactttcaaatttagtgacaatataatctgcaagcgaccagatcataccaataaatgaaaacagcacgtaaaatggagtaataagaacgcacaataatatggctttaattatcagtaacatcttgtatagagctttttttaagacagatagatttgttttatctttcataattcgtacaggtatgtatgtgcctcctccttcttttgatctatccatataataaaacatttggcttacagctctgtgacttccagatgagagatttgtcacttttggaataggaacagctttaaccgcagcctttgcctttcttccacagtatacgggatacatacagcagcaataaaacgccccacgaaccggcttcggcatatgcaatgatcatatttccgcatatgccggcaaaagcatatgaaaacacaatacgtgaaatcaatgaaataatcccggcgatgcttgagaacagtacgtccccgattccttctatgtaaccgcgtatcgacatcgcaacaccgtaaacagcataaaaagcagcgattctccggaagaaatttctcccgatctctacagcctcagggcttaccccaaacaaagagattaaatctcctccggcttctactaccagccatgtgagcaataaagacacgcaaagcatcattgctgttcccacatatacggtctttgtagtctgctttttcttacctgccccatagctttgggcaacgatcgtagaaattcccgaacccagattgataattggcaaaagtatcattgtatccacacgatatgccgtagtaatcgccgcaaccgtctgtgtgccgaatccattcatgaaattctgcaggataaggccgcctaaagaactgatgcaggcctgaatcataggtgggattcccagatgaagcccctcacgaagaacagatcgttccggcttccacttctgaatcttgaaacgcaggctgggatacttttttacaccgtaaatgataataaataccgtcataacggcctgtgagatcactgttgcagctgccgccccggccacacccccatgccatacgcccacaaacataatatccagtatcacattcacgatggaagaaaacaaaacagagctgaatggagcatggctgtttccgattccgcgaagtgcggcagcgtaaacattatagaccgccaatatcggtatcccgaccagtatgatctgcagatattgctttgccatatcaatggtatcctgtgtcgtgttcatcatctggagtaatggaaaagctccgatgatgcctatgagcgagacgagcagaaaagtaccgccgattatcaccgaaaacaccgaaagtattttggggatgtggttctctttcccggcgccatatttctgtgcaaataaaatagaaagcccgagtgtaaatcctgtgatcgcagttagaaacagattgatgatcgtagttgtggagccaattgccgcaagtgctttttcgccggctatattgccaacgataaatgcatccgcccaattataaagctgctgcagaattccgcttaaaatgagcggcgtacagaactttattagtgttactgctatgttttccgtcttgttgtttttattgtacattttcagaactcctcagggcaaaaaataccgtatgcaagaaaatagcctcacatacggtaggtgcttacccgataatactatggagtataccaaattcatgaaacatttacaagacttctgtctgctaaaatagatttaaaaaaatgtaaagcctctcttcataactgtcttttccgatggaacggttatttataatatgacgcatttaatatttatcaaaataaaaagacacggagcccgtgtctttttatttactgctttttattggaaaggtcttttcgggccttactttttttataatttaaaaaatacttaccgtattctgtggctttctcaataaaaaccgccaatactttatgcatatttttaagaataatatcgacatctttggaatagcagccgccatcttctttccggatcatcttgccggcagacagcatctcacagctgaaatccctgcaaacggcaaggcacctatccacttcgcttatacttatattatccagcgccgtttggtagctggttattgtagcaagccggagcagccgatagaaggaatcaaaaaatacagccattactccttcgtctttttttatattcatatgcctgcataagttttctgcgattttttcgttttcttcaatcagaagctcgcattgtttaccttctgcaaactcattttgaatgattttcgcctccccatttctgagcagctttatatactcatccacaagcatacctgtcattaaatcgtaaatcagtgacacactctcaaaagaatgcagtttccagtggatgtgttctgaccagacctcatctccgatcaatctaaagttcatctccatattttgctcctttttacttcctttctttttattcattagtttttgtatatcgggaagcgttagcagttaaaatattccagatacacttgatcgtattatatcacattttttttgcctagtgaactattttaggaacagcatttttcgattttttagtctttcatatctgtgaattttcttgtatttcaaagagagacattctataataatatagtctgtgttttgacagaaacttacgatgaaaggatttagaaatagatgcagttacagagattattaagttttacacgaaaagcagttgatgaatatgccatgatccaggagggcgatcatattgcagtgggaatttccggtggaaaggacagccttacgctgctctatgccctgcatggcctgaaacggttttatccgaaacagttcgaactcagtgctgtcacggtggacctgggattcgagaaattcgatttaactcctattaaagagctttgcagggaactggaagtgccctaccatattgtagattctgagatctatcacattctgtttgatgtgcgaaaagaagccaatccatgttcactctgtgcaaagatgcgcaagggggcgcttaacgaggcggttaaaaaaatgggctgtaataaggttgcgtacgcccatcacaaggacgatattattgaaactatgctgctctcattaatctttgaaggcagattccattctttctcaccgaagacttatctggaccgcatggatttgaccgttatccgtcccattatgtttatcaatgaagcggatgtaatcgggtttaagaataagtatcatctgcccgtagtgaacagcaaatgtcctgttgacggatataccaagaggcagtatgcgaaagaactggtaaaacagctcaatacggagcatcccggtgcaagggaaagaatgtttcatgctatattgaacggcaatatcaagggatggccggacagaatcccccatatcagataggagccggaaatgccggacagcgttatgtaaactgctgtccggcgtttccggctcttatctgatatgggaatacttctttaaagctttctctttgcagatgctatgccctcttttaaagctacgtactgttcaatcgcctgtgcggtcccttccacgccgagttccccgctgttcaggcataattcatagctttcggcatctgaccactttttattcgtataataattgtagtagctggcacgttttttgtctgtcttgattatgatgtcttttgcctgggcatctgtcatatcgtgaatccgtgcgattctgcggacacgggcatccagatccgcatggataaatacactgactacattctcgtaggattctaatgcatagtctgcgcatcggccgaccaggatacacggcccctcgttcgcaatctttttgattgcgtcaaactgagccaggaacactttatggttgatcggcatatcggaataggtgctgccggaatatcccatggaataggtatccatcaccaatgagtacagaaagctgttcgttggtttctcgtcatgggattcaaagatttcctcgcagatcccgctttctttggcggcccttgccagcatctctttgtcgtaaagcttaataccaagatgttccgctaccttgtagccaatctcgcgccctccgctgccgtactgtctgccaattgtaatgattgtgttagttttcatatcagtcactctccttttacgtcaaaccagcatatgttgtcctttcgtggaataacttttatacaattattatacaagatgacgctgttttttacaacatgaattgagtttattgtgcaattttcataattaccggggaataattcgagcggtctgaactgttccattatcggtgtcttaacgtattcaataattggagaaaatattccggaagcggcgcatcaaattccatatactcccccgtcataggatgtatgatgccgagaacctttgcatgcagtgtctgcccctgcagtttaaacgggcatttggcagggccgtagacggcatctcccacgattggatgcccgatactggccatatgcacccggatctgatgtgtacgtccggtttccagttcacattcgatataggtgtaatctccgaaacgctccagcaccttatagtgtgtcaccgcactgcggccgtgagtggcccttgtgctcatctttttcctgtctgtggggtgcctgccgatcggtgcatttactgttccgtcgtcctctttcagattgccgtgcacaatggcatggtatttccgggtaatgtggtgctccttcaactgttcggccagtgactggtgtgcagcgtcattcttgcagataagcagagatcctgtcgtgtccatgtcaatccgatgtacaattcccggccttgcaataccgttaatgcctgaaaggttatctctgcagtgatacataacagcattgaccagcgtgccgctgtaatgccccggggcgggatgtacaaccattcctttgggtttatttacgatcaggatatcgctgtcctcaaaaagaatgtccagaggaatattttccggctgaatatcgggtatttccggttctgggatctgcacttttatctcatcacttaccgcagttttataattggctttgacagccttatcaccgacggttaccaggtctgcagcgatcagcttctgtatatgggatctggagagatccggaatggcttcggcaagaaatttgtcaatccggacaccggctgatccggcagtgaaatataattcctccataggccttttatcctttcttcagcgaaaagcagctcagctcgtcctctttatagtaaaaaagtatagcaaaagcaaagaggatgcacgcaactaccacatagcagtccgctatattaaagatgggaaaattaatcagctcgaagtagaaaaaatccaccacataattcagccgcagcctgtcaatcatgttgccgatagccccggcgcaaatcattaccgcgcagatgcgcagcaggtaatagcgggacgtatgcggcatccttccgtaaataaaaccaatcaggcatacgatcacgactgcccctacagcaaacagaatctgcctgtcctgcataataccgaatgctgcgccccggttttccagatattccagcttaaatacgcctttccagatcacgaagggctcctgatcttttaaatgtacgacggcaagccattttgtaaactgatccagcacgatcaggacgatacagccgaggacggccagcagataactttgtatagattttgtattcttatctttcatggtttttccttttcttcgttgaagtcatgtatggcgcacagcaatccggcgctatatatatttatggatgattacgaaaattctattcttttttgtgcgggacaagatacctttatactggaattttcccatgcctctcacggatataatatcgtcttccttcacctggaacccatttgttgtcataagctttccattgacaaatactttaccgccctcaatcaaaccgctcaggcgtgtccgtgaggaggagaatgccagggacaaaagacagtccagcctgacggaggccacagtacctttgacctcctcaaaacggggagtatactggaagtcctgcacgttttcttcccggagcataacgtttgtgcggcggacccgggtcagctgctcctgaagataaacgctcaggccagtttccacaaacagaatggccttattaccttcaatcagaatatctcccagtctggaacgctctattccgagattcagcacagcgcccagataatctctatgcgtcagttcttccgcatatttctcatgcagcggctcgatacaaagaacagaaaaaggaaatcccagggtttccaggtctgctgtgtcatcgctgccacgcaaataaagagcatcaggtaggaatgctgccatctgacgctctgctgtgtcatatccgccgaaagtcacatagcgagtatacagcctgtccttcggcaaagaatgcaaaatattcagttcattcaaattcagaaaatccgaatatgtaatgatgtcacggtgatacgccgtcctggacagctcaatcagccgtttttccaaaagctgttcttctttttccatgccagaattaatatcttcctcttacattagctgtctccatagagccgcccagcagatcctgaagatcacctgaaatatcaacattcgtcggtgttacaaggaatatatagttggaaatcttctgcaggtttccgctgattgcgaaagtcgctcctgagataaaatcgatgatcctctgcgcaatctccagatccatgccctccaggttcaggattacagtacgccctgccagcagtgtctcggtaatctcgcgggaatcgtctactgatgtaggctttaccacgcagacctccatgttggcattgcgtctggaagccggctgacgcatcggggttactttgttattgctgctgtttgcaggagcatatcttttatcctcctggatatcaaaatcgtcgtattcctctttgcttttcttattaaaaagagaacggcgtggtttttcatcaaaatcatcatcttcaaattcgtcatcatagaaatcgtcgtcatcgtattcatcatcattcaatttcatgatgtccaaaaatttgtcaaacacacccatgtttacactcctatcttatgccctcttgatgcataaattttttttgaaaatatactttctgttccagatcctcatgccttaacggcataatctctggcaccaaagattccggttcctacacgaaccatggtcgcgccctcttctattgcaacctcgtaatcattggtcatccccattgaaagtatgctcacattaacattatcaatgtttttgttcttaatgtcaacagataatttatgtaaattctcgaaaattgggcgattatcctctggattttcaacaaatggagcgattgtcatgagcccgcatacacgaatatgcttaaatgatgcaattttttctataaatggaattacttcgtcaactttaaggccgaacttgctttcttctcctgctacattgacttcgatcaggatactggcgatgcagtttttcttctctgcttctttctcaataacctgagcgagctttaccgaatccacagaatggatcagttccgctttatctacgatgtattttaccttattggtctgaagatggccgatcatatgccagtgaatgtcatccggaagggcttcatacttttccgtaagttcctggactttattttctccgaatactctgacacctatatcatatgcctcttgaagtactgcaatgggtttggtcttgctgaccgcgattaaagtcacttcactgcgctgcctccctgcgcggtcacaggcggcctgtatcttctcttctacttcttgcaattgctctttcaacataaatgacactccttgtttatataatatagttaatagacaacctcgtcctcatctaccgaatccccatcctgaacgatatggtcgtaattataaagtccgtaggaatccccttccttgacaatataatattcatcgctttctgcgaggatcgtaacctgacggaatacagcatagcctttgttaatattaaatacacccttttgagactgtgtctctgacagggctaatgtctcggcggattcgggctttacaaggacggtgcccctcttcagcgtggaagtgctgagatatacgctgccatcctccgtagatttgtatatgtcagcggcctgaaaaactgcattgccgccgcgcttttgaaccatgactcccgaagcggaactgttgccgcccgtagtgatatactctgagggcaccacaaagaactctttctccacaacactgcttttcggaatcttcagtccgctctcatcctcaaggatgagctctatatttaaaaatctgtctccggcataacggatcatggaattatcgtaatccagccgtccatagtactcaccgtcttttttcaggatagaaaagtctgcccagatggattcgctgtccttatctattctggtttttatgtaggtcgtatcagccagtttgcctgccatatccttgtccaattctataatcacagaccacttttcatttgtgacaagtttgtaggctggttcccccttcttgacctgcatattatcttccaggctcacctttttgtagctgctcctgtcaaagtctgcttttttgaatgaatctgcggttaaagactcacagccgtcaaaatcaagaaccataattccgtcccgcggtgtctgatatacatctgcgctcacaccgttctgggacagcacagcatccatctgcgctgtcttggtttgattagaagcattctgcagggtgttgtcgatttcatttttcagggaataaacagaggagaacttctgcggattaaaattctcgttaaagctctgcgtttttacgatcagggtattctgttcttctgtgctcagagaagtctccgtgctcgtctcctccggataggttaacttttgcgaggtaaccgcataaacattcgcaccggccttaatcttgctgttctcgttttgaaaataattgatataccctgtgttctctgcataaaccactgtttcctcacggaggatgagccctgtgtaggaattgtccgtcagaatactgccttctcttacctcataaacagagattttctttgcagcagcatacatgacaatcgttactataagataaataaatacaattgcaaaaataaagatgccgatattcatctcacgttttcttttatacttattaatactgatggaattgtccttccgtgatgccaaactaatcttcctcctgtaccgtaaatcaattttcaaaatgatacaattattatgataactttactagtataacatttttaagtgtatatttccagtttttgtggcaataataagagcattgatattgaaaaggaggaaataatatgaagtggtttgataacactgctctgacacttgtgattatcggggcggtcaactggcttctggttggcatttttcgatttgatttagtagcctttctctttggaaatttaagctggctttccagaataatttatacgattgtcggcctgtgtggtctttacctcatcagcttgttcggcagaatcaaaaacatgtcagagtagatgaaaaaggtcgcttcaaaagagcgaaacaacagggaacccggtggaagggcatgtccttccatcgggttctttgtttttggtctgcgctagtatatcatatgataagtcacctattttccgatatactagttatatgcctaatcggctgcctctgcagctgcagccggtctttcgcctgcagacagcatagcgctcatctggccgtacaggagatcttttgtccctgcccccattataatggatatataggggttggactgggaatccttgctgtataagatgacacaggagcctgcttcgtcggtagtccctgttttacctccaataacctggacgccttccggatcgggaataagatcctgggaataaaaattggtagcctcccacacctcactgcgtacgcttccgtccgctgaggtaagcgttccagtataggaatccttcgatatgatatccaggaagcgctgatcctttatacaggcgttgaagatcaggtataaatcgtatgccgtagtgtaatgattgtcgtcctgcagaccatgggggttgacgaaatgggtattggtcgctctcagggaagcggcctctgcattcatcatatctgcaaatgcttccacactgccggccacatgttccgcgatcgccaccgcacagtcattaccggaatagagtaaaagcccgcagagcagatcgtacagcgaaaccatatctccggtccggaggccgcatgtctgctcgtcctcggcgaactgagttgcattgggcccaacggttacagtatcctccagattcccgtatttcagcgtcacataggctgtcataatctttgtcgtactggccgggaaaagtctttcatgaatcttactggcatagagtaccttcttatcttttatatcaaaaagacccgcagcatgcaggcccgggtccgcactataaccctccagggcaacatcggtatctgtaacacacaggccagacgctgacagggttcctctatatattgaacggttatactgttcctgctcgtatacttctgcttttagtacttccctgctgcatcctgcgataagcacggacagtaacaggcaaagggcaagaacagctcttttacttatacatctcacgccagtccaggtctcctctgtctaatgccaaaatcaaagcctccgctgttgctatattcgttgcaataggtatattgtacatatcgcatagtcttacaatatcgttcacatccggttcatgggagcgcggtgtcagcggatcccggaaaaagataagcagatccatctccttgtgttctatctgggcgccgatctgctgcttcccgcctaaatggcccgcaagatatttatggatattcaggttagtgacgctttccacaagagcccctgttgtctctgtagcaaacagatgatgcttgctcaaaatccccctgtatgctatgcagaagttctgcattaatttcttttttgcatcgtgtgctactaatcctatgttcatgtcctgtaatctcctctactgatatttattgggctgcagaccgacattcagcacaaagccgatccccatataaaaacatacgacagaagtcattccgtaactcacaaaaggcagggaaattcctgtattcgggaatatctgagtagccacactgatattgataaagctctgtactcctatcagtgtggcgacacctccgcagataagccgccctcctgtgtcttttgcttttactcctatcaaaatacacgttattacaattaataataacaaaattatgaccacacaacaacccacaaatcctaattcttctccaataattgcgaaaataaaatccgtttggggctcggaaatgaaatttccgttctttacagaggtcgtggtattgctgttatagcccttacccgacaactgtcctgaaccgatggccataacagagttaatctgctgataagcttcatctgtagcgtatttttcgggctccagccaggccaggatcctcgcctgctggtaatctttcaaaaagggctggttgggctgcacgacaatggtcagaaacagcgctgcagtcggtatggtaattgccaggacagtgccaataaacttgtagcttaagcctcccatatataacataatacaaaatacagttgccagacagatggtgtttgaaaggtttggctgcttgtatataaggattagggagggcaggatgagcgcggccgcctggataatcgtctttttattattaatcgcctgctcccgctccatcagaaacttcgcaaagaacagaatcgttatgatcttagtcaggtcagacggctgaaactggacaaatcctagattcagccatctggtagctccattgatattctcaccgaaaaacagcaccgccagaagcagaacgatattcacgccgtataaaagccagtacatattcaggacccattcgtagtctatcagcgaaataacgatcatggcaatcgtgcccattacaacaccggcaatctgttttccctgcacagatgcctgtgcacttcccaccacaaagatcccgataatggagattgtggtcacaagtgcgactaggctgaatttataatcttttaagttatacctttgcttaatattcagaaaattaaatttcaatagttctctcctgtaatcttaatatgtatatctgaatgggttatcttcatgtggaaatcttccggttttacttccagatacttggaaactgtgtgatacatatctgaagaaaatttttccgctgtttcgggtgtacactgcattctgtctgccataagcagggttttcaatctttcttttgcaacgtgaacagatggtacactcataatattccctcctaattctttttaaataggctggaaaatcttgcaaaaataccttccggtttgttgaaatcttcaattggaagttcttctcccaggatacgcctgcatacattttgataggcatgtcccgacatacagtcggctcccacaatcggctcgccctgattggttgcgatgacaacatgctcgtcgtccggaatcacgcccagcagattgatggccagtatctcggttacatcatccacggacatcatatccccgcgctttaccatatccacgcggagacggttgataatcaggtcgtttttcttgatgccatgtgcttccagcagaccgatgatccggtccgcgtcccgtatggcagatacctccggagttgtaactacaatcgccctgccggcccctgccacagcattctcaaatccctgctcaatccctgccgggcagtccagaagtatgtaatcaaattcgtcttttatgtcagcgattaatttgcgcatctgctcaggagatacggctgtcttgtccttggtctgggcagacggcagaaggtacagctccggaaaacgtttatccctaattaaagcctgtttcagcctgcagctgccttcaatgacatccaccagattatatacgatccggttctccagtcccataacgacatccaggtttctcaggcccagatccgtatcgatcacaatgaccttcttaccaagctgcgataaaccaattccaatatttgctgtcgttgtcgtctttccgaccccgccttttcctgatgtgatgacaattacttctcccatgttttcttcctcctacaacttctattcgtccacaagtggatccacgtaaatcctgcgtccgtcaaccaccgctatcttgggcccccggatgctgaggctttcctgatagatgacctgacgttttgcttcaatatcgccaattcgaagttgtttcggctgcatggccagagctacgacgaacgcatctctgctgcccgcagctcctgcatggactgaaccagacagagaaccaacaatgacaacgtttcctttggcaattactttagcacccagctcaacatcaccaagaatgatgatgctcgaatcggattccagcacctgtcttttgcttaaagtacctctgtagaactgcccttcccttttctgcatattggtgagcgtattctctacaatgcttttgtatgtcatttcattggtctcgtccctgtctataatgcagacaatgtcaatccccgttatctcggcgatcgtatgaaggaccgcctgttcttcctggtctgagagtttcctgtccagaaatgtaaccgccatcttggccccctcaaagaatttcgccgagtctttgaatttggaggccacgctttccagtaaaacgttaaatggcacttccggattcagatgaacctcaatcccgtatctgttgctcttaattgttaccagcttgtccatgtatcttcttcacatccttttctggtactataggcactggaacctgcgcaatgtagtacttagtcgcctgcaatggttgtaccaagctgtgcggcagaaccagtgatcaattcttctttgtcggcgagtttaaagttcgccctgacaatatccctgccaatctcggcagcgtaggatgagctgtaaccgtttgcgatacgcactgaaattgcaatctccggagattccgcaggtgcaaatccaacaaacagaccatggtccggatggatgtcgctctgctgcgcagtacctgtcttacccgccatggagatttccagaccggaaaagctggaggtatagccaatcatggcgatcattccctgatgaaccagatcccatgtggtactgcttacatctttaatctcgttggtgacgacaggttcatactgcttgatgatcttcccgttgacatccgttgtcttattcaacagggtcagcttatatacggttcccttatttgcaacagttgacacatatctgttcagctggctgaccgtatagttgttgttaccctgtccgattgcggacagcacggagtattcatccgatatctggggctctgattccggtatttcaatgcccgatttttcaccgagcccgaattcttccgcatactttgcgagcgctttgacgcctttatcgctgtcgtaattaccatctttatcaagccccaggtcatatccgacttcatagtaaaagtcattgcaggaaaccttaagggctccgacaacatcaagcatgccgtgagctccgggatagacccagcacctcgggcttggcgtaactttgtcaaactcgccggagcagttaatatacgaaccaccatctatgacgccttccgtgagcgctgctacagaagaaagcatcttgtaggtggaacccggtgcagtgcgttcctgtgttgcattattgtaaaacggacgggaaagcccggttacaagctgattataatacttggagtccatggtgttggccagccggttattatcgtatcccggataggatacacacgccagcacttctccagtattcggatcactgacaacggcagagccggtacaaggttccagtgcaagctgaccgggagtaatctccaggttctggatcttctggtacagccatgagaaagaatttacgctgccgtcgatcagaccgttatatgttccctcatccatgggcaggacaccctgctcatataccatggcgcagatctggccgccagtgatactacctgattttataagatatttgtagagaagtttgtcgaaattaacatctgaaaccaaataatcttgtaaaaatgttaaaattccctgataaatttctgcggaatcggaatatttctctgcggaaacgtaatcagacagctttgatgtgtcaatccagttcttggatattgcataattcagatattggttcaggctgatagtctcatcagttgtccactgtttatatatttcatcactagtatcaatggagtcctgcatcaggacccctgcggcttcctgcagaacgtcaatagagacataatccatataggctttcatttcagcagaaagatccttataggcagcggcgccgctgttattcagctcttcgataatctcctggatcgctgcagtttttctgtccgaaaagattccatatacctgtttttctactgttttggcatcgtctgccccaaaatgtgtttcatcaataatttcatttgcgataaatgcattgtaggcatcatccacagggatgataatctgggatgaatcactcgtcttgctcggatcgtaattcatctggtctctgagcttggacagtacaattccggccagtttttcttcgatcagctgatacgtctgctcctgcagatccttgtcaatcgtgaggtaaacgtcattgccggcttccgggtctttactgctgaccgtctcggttactttgcccacactgtccacgtagtactgcgtctgtcccttggtgccctgaagtacctcatccatagtctgctctagccctgatttgccgataatatcagtctgggaatatttctttttctgatccttatccagagagttatattcttcctgtgatatctttccggtatagcctatgatggaagcaaaatacttgctgtccgtataacggcgcatagaatcttctgcgatatccaccccttccagctgatccaggttctccataatagaggccacggtctcatcacttacatcggtggccagtgtggtcgggatatacttctggaagctgttcaggccgattgcgtatcggaggttcaccatttttaggatatacgtcttgtccagtgttttaacatccagtccgtaaccgtaggtttcatccgtacacagataattgatgatatcctctgcagatgcattgcgctgcttgtccttcagttcgtcaatagttttaagcccatagacgtccgcaataaaacgcagcttaagcgtctcatttgtctgtgtaaactcataatttcctgcagaatccagaaccactccgaagtcactgatcacggaatccccgttggactccacgatgtttatgatcttatccagaatctcattcaggatccggttcttttctttccgggtgtcggcggtgatattatcttctattgtcacggaatacgccagttcgttataggccaggggggtgccgtttctgtcatagatattgccccgtgtgcccggcacctcgcgggtctttcggatctgcagcttatagttgtccagataatactgtccttttacaatctgaagataaaatacgcggttgatcagcaccgcaaataagatacagaatgcaaggattaaaacaaacagccgtgactttacgattcgatagattgcatcttttatacgctcaaacaaatttacttgcactccttttttcatctgcttccagtttatggttaaaatataaaatcaatgggtataatccgagagcaatcacaatagtatatatgagctccggaatgatattatgactgaaatagtatataaagttgaattcactgcgcagcatgaacatcaaaaggtagatggcaagcccgtataggaactcgcttgctgcgatcagaaccagcggcagtttaacgtcttcgtcgtagtatacctgctgaaacaggccgttgacaaatcccagcagcagatagatcatggcataaaatccgatgataccgccgaactggatatccataagcaggccggaaaagaagccgaccagcatcccgtccctggaacccctcatgaaaccaaaagaagctgttagaataatcataaggtttggtttgattgaagcgagagccaggtgcgggaacagcgtacactgcagcaaatagcatataatcagtataaccgccgttacgcctgctctttttgccttcatctttttcatctgccgtactcccctttcctgccggatattgcatacttccaattgcttttcattattcttctgcgtccttgcctgtgagatccgcctttgttgttgtaattacaagcacctcctggaggttcttaaagtccacgacgggtgtgatatatccggagcgggtcaggttattggaatctacggtgatctcgctgatataaccgatcaggattccctgaagatatttgggactgatatgtgaggtgacgatctggtctcccacctgcactttattttcattgttttccatctgttcaaaacggattttcccgtcattgatcagtgatagatcccctcttaccatacacttgtcggatgtggaaagtgacatgccgcttacgttgctggagtcatcgatgatggaacggaccgtggaccatgtggggcctgttttgatgacaattccgaccaggccgcttcccgccataacgttcatatctaccttgatcccgtcattactccctttgtcaatcgtaaaggtgctgaaccagttgccggaatcttttgcgatgacatgagcgcctgttttctcatattcggcatagttctgatccagtttatacagcgcctgcagccgttccagttcgtacttttcctcctgcaggttattgttctcggtgatcagctcatcaacctttgtctgtagtttttcgttttccttcctcacctgctgcagcgtatcaaaattgtcgcatatgtcacccagccaggtgccgatctgattgatgcccttctgcatgggaatgactgttacgctggcaatccctttgaacggtccctccgctttgtcggaaaatacggacagcaccatcagcaggatgcagaacagagaaagcccggccagccagtatttatttgtcgatgaggtttgatttttctttttcatattatctcagccacctataatcttcatctaacatggaatatgttaacttactgtaatctttgttcagtataatcttcttgagcccgcttactgcacagagctcaggattttgtaccgtccgcactccaaggccggtgctttcctccagatatgtagacagccctttcagattggccaggccgccggtcaggcagattccgttctggtcaatcccccttcgtacatcagggggggttctgtctatcatggatttgatggcacggacgcaatcagacagcggctccttcatggcagccctgacgagtccgataggaatgcttttctgctgtggaacacccgtaataagatttcttccggcaacagtcagcgaagcatctgctgcctggtcaaataccccgaattcccgtctcaacatctcggctgtcaggcggccgatcagaaagtcacggttatgccggacgagatgggtgatggcattgtcaaaatggatgcctccgatcttgatcaaacggttcaagaccataccgccggaggcaattacagataattccgttgtctcccctcctatattgacgataaagatacccttttcattccagatgtctatatccatgcccagcgcatcggcaattccgcgctctacaatccggacggatttggcttttgcggttgaatggaagacaaggtcgtaaaaagccctcttctctacctcagtcacgtccgtgggaaccgcgattacgtattcggccccgcgtgaaaactgccggtccatttttagcagattctggagcagatactgcatgtcatcaaaatgtgcaatcaccccattgtgcatggggaataccactttgatattatccggcgctttttcatacatcttatatgcttcgtcgcctacagaaaaaatatactttttgtcctgcatggcgatgacattcttcgctttccagatctcatcttttttcttatcatatacttttatctcatatgttcccaaatcgagtccatatacatttctggccattgtataaccttcccctatccttatataagtcccttttcccgcatactgatataacaattgttgccgatcaccagatgatccagcagctcgatcccaatcaatataccggcatcctttatccttcttgtaacaaggatgtcatccttgctcggtgtcgggtctccgctgggatggttgtgaagcagtacgatagaaaccgcgtttttctgcagcgcttctacaaacagctcacggggcgagattacagccgaattgaccgtccccttcgatatatcagtctccccgattaagcgggtctttgtgttcagaagcagaagtttcatggtctcctgccttttgtgccgcatgtcttccatataataacgggcgaccgaggccgggcttgtaaagttcagcccaatctccgcagctgccttggaaagccttttggaaagctcggacagacataggatctgtactgccttaactttgccgactccacggactaaaagaagctgttcctttgtccactgatgaatactcaggatgccctcctgggcaaaatcgggatgcagaagcttctctgcaagctgcagggaattctctccccgtgtccccgtacgcagcaaaacagccagtaattcaatgtccgtcaaattactcgctccatattttgcgcatttctcataagggcgcgcttcttccaacatctctttcattgtattgttctcgttcataaaattgttttgactgcggatggctcaatacaatgatttattttagcataaattaaaaatcatgtataggtctgctattcttaattttttgtgaagtcggataagagcttagacttactcaagtatactttggtgtatatttttgaataagtgcttctgctgtcttgatcccgtccatcgcagcagaggtaattcccccggcatatccggcgccctctccgcatggataaagtccggaggcagcggggctttcgaagtcctcgtttctgataattctgacaggggaagaggttctgctttccaccccggaaagcagagcatcttcccttgcaaatccatggattttatgatccatggcatagatgccttcttccagagaatccgccagaacgttcgggaaaatattcctgacgttggagaatgtccaggggcctttgatctgaggcaggattgtccccggctctgttgtggggcggttactgcagaagtctccgaagcgctggaccggaactttcccgttcccttccttccatgcgcgctcctccagcattcgctggaattctacgcctgcaagcgggtgatccgtcccgtaatctgctggtgttacagtgacaatgaccgcgctgttcgcattggctccgtctctcgcgtggtagctcatcccattgactgccaggcggccttcttcggaggatgcgttgacgacatatcctccaggacacatgcagaaggtatacgctcctcttccgttggaaagctgggccgtcagtttataggatgcggcgggcagttccgggcagtctgtttttccatactgacactggctgatcattgactggggatgttcaattctcacccctacggcaaaggactttgcctgaacagggatttgtctgtcatacagcatccggaaagtatcccgcgcgctgtggcccacggcaagaaccagaagctccgtgtccagcacctccttgttgtttacaatgacctgtttgatgcgaggctcttcggagggggcggccaaatccagcaggatatcagttacctggctatggaacctgacttctccgcccagatccagtatgctctgacgcatatttttgaccacatcgatcagaacatcggtgcctatatgcggcttctgttcaaaaaggatactctcaggagccccatgtgcagcaaaaatctccaggacaaagcggtttcttcctttagaatctttgaccagcgtattcagcttgccgtctgaaaaagtgcctgctcctccttccccgaactggacattggaggacaaattcagtcggccgccgttccaaaaatcttccacatctttgatccgttcctccacgcagctcccccgttccagaagcagcggccggtatccgtttttagccagcagataggcgcagaacattccggctgggccgctgcctgcgatgaccggcctgcggggtaacgggatgctgcccggggcgggcggctgataggcgctgacacggatctgccgcacctgctttccggctcttttcagaacctgattctcatgccttacctcggcatccaccgtataggaaaagaacacatccggttttttacgggcgtcaatggactgcttctctatgcgccatccgagcagatcggactttttaacggatagggtttttaaaagttttttctctaattcctccggagtatgccccggatgtagattgatctggctgactctaagcaccggcagcctcctttccggccacataaccgctggaccatgcccattgcagattgtaacctccgcacagaccgtccacatccagaatttcccctgcaaaatacaggccggggacaaaacgggattccagattgtctgtgatttcctccgtattgatgcctccgcggcatacttgggcctgctcaaaggagttggtctccgttatttgcgtagaaaaatgctgtatcagacgtgcaagggcccggacctcttccccggtccagtctccgaccgccgcggacgggtcaagatgtgccagtttcagccacagtacagagagctttttatgaaacagaccgacaaaaaattcttctgccgttttttgcggacgggcagtaatccgttttttcaaaaaggccaggaattgttcttctgtaaaatccggcataaaattcaacactgcggttactgcttttttttcgtataggccgatcgcggcacagcggctgacctgaaaaaccgggattcccgatatgccataaccggtaagctggatctccccagtatcctttgcctggcattcaccgtccgtatagatagacacgcttcctcctactcgaactccggaaatgcttttgtaaaaattctctctgcatttcaactgtacaagggaaggaagaaccggaaccagacggtgtcccagctgttttgccaggccatagccggatccatcggaacccgtggatggagcagccttggaacctgcggccaggatgaccttctgaacatgaaaactgccgtgatctgtctgtagcagaaatccttttttattgggaatgatttctctgcattctgtctccgtatggatctctatcccaaggcggcgcgcctccatacgcagcacttccaggaccgcggatgcctggtcagactgcgggtagagatatccgttcctgtttttagaatagatgcccagttccagaaaaaatgcgattgtctgctgtgcattgaatttttcaatgaccttccagggaaagagaacattttcagagtggtagcagatcggttcctggtgcaggttcgtaaaattacacctgccgtttcctgtcgccagaatttttctgcccacccggtccttatgttctagaatacagaccccggcgccgtttcgtgcggcggtaatggctgccatcaggccggatgccccgcccccgattactgcaactttattcatggatgtgcctccttactagagcagggatacggctgagaccagccccgcatccaccatgctctgcagtgattttaaaatcccgagtttcgcatggggccatgtcaggccgccctggaaatagaccgcgtagggcggtttgattgggccgtccgcactcaattcgatagaggagccctgtacaaatgcgccggccgccatgattacatcgctgtcatatcccggcatggcccagggttccggtgttacgtaactgtcaacaggagctgcggcctggatgcccttgcaaaatgcaatcacgccttcgggggttcccagttccactgcctggatgatatcatgcctgctttccctgctgtttggtatcaccccaaagcccagcttttcatatagatatgcggcgaatacggcgccttttactgcactgcacactacggtaggggccagaaaaaaaccttggtaaaaggactgcatgacgccaagggatgcgccgacctccctgccaagtccgggggatgtcaggcggtacgcgcagttctcaatcagcgcctccttcccggcaatgtacccgcctatgggagccaaaccgccgcccggatttttgatcagggaaccgacgatcatatccgcgcccacatcgcttggttcgattgtttcgacaaattctccgtaacagttatctaccatgcagatgacatccggtttgatccctttgataaaagcgatcaattctccgattttatgaacggaatagctgggacgtgtctgatagcctttagagcgctgtatggtaaccagctttgtcttttcgttcagcgcggccttgattgccggatagtcaaaatacccgttttccagcagttccacctggcggtaggtgatgccgtattctgccagggaaccttttgattcacggattccgattacttcttccaaagtgtcataaggtttacccacaggagaaagcagctcgtccccggggcgcaggtttgccgcaagggcaagggcaagggcgtgggtcccgcaggttatctgaggacgtaccagagcggcttctgtgtggaaggcgctggcgtacaccgtttccagtgtatccctgccctgatcgttgtaaccgtatccgcttgcgaactgaaaacagccttcgttaacacggttttcctgcatcgcatgcagtaccttcagctgattgaattccgcagtcttttcaaactcacggaaccggggggcaagctcctcttccgccttgcgcccgaattcatatacttcttttcggatacctaattcttcatacatctgattcatttctaagttcatactgtgatcctcatctatcttctttctctattatcctgcgtttttccagctcattcagcatccgtgcaagaaggcgtttctcatcataagcaaattcctgtttattcagccagatgacatcctgttctcgtttgaaccaggtaatctgacgctttgcaaaatggcgggtgtctcttttgatcgtataaaccgcttcatccagcgtcatctcatgatccagataggccatcatttccttgtatcccagcccctgcatggagactttatcacgtccaagaccgcgggcctttaatgattttacctcttccacaaggccttcttccatcatccggtcaacccggcggtcaatccgttcataaaggcatgacctgtcatcatgaagcacaaaatagacataattatacggagattcttttttgcgctcttctgtattgtgatccgagatacgcttcccggtctgctgataaaattccagggcgcggatcacgcgttttacgttgttctcgtggatatcttcggctgatttggggtctttttcccgcagcattgcgtggaggtatgcagctcccttttccctggcaagctgctccagatgctctctgcaggaggaatccccctcattcgccgtaaaggcgatatcatagagcagggcctggatataaaaacccgtgccgcccacgacgacgggaatgtgtcctcttttatagattcctttcatggcctcctttgccatctgctggaagcgcaccacatgaaagtcctcttccggatccaggacgtctacaagatggtgaggaatcccctccatttcggcggaccgtattttggcggagccgatgtccatataccggtatacctgcatggagtcggcggaaataatctctcctcccactgcttttgcaaggccgatggaagccttcgttttgccagcggcggtcggccctgtcaatataatcaatggctttttcatttatatgatcctcttaaatttcttttccagttcccgcttcgtcatggcgataatggtcggccggccgtgagggcagtgatatggattgtctagctccagcagctcctggatcagtgtatccacttccatggcggacaggcggttatttccttttaccgcagccttgcaggacatggacgccaccttctcgtcaatcagttccggtgtcatggaagtcgtgatcccgtcggccagactgtccagcatctccaggagcagctccttctttgcaataccgaacagattgtccggtattgcgcggactgcatactcatcccctccaaagggttcgatttcaaacccgattcttttaaaccgatccatatgctcattcagtagctctgtctcctgcatcgaaaggctgaggataataggcggactcagatactgggaggtaaactcccggtttttcatgcctttgagtgtccgttcataaagaactctctcatgggcggcatgctggtctatgatatagaggctgtcatggaactgaacaagccagtacgtatcgaatacctggccaatgagcttatattccgcctttacctcgcgcttcagcagcttttcgtcgaaaagattcagctgttccgtcttgacgggggctttctgcttctcagaaggttccgcattttcaccataaactgcccgctcttctgaaagctgcattggtgcttcatttgacgaaccagagactgggatatccccggcttcccggatggttactgccggcaggggctttgcatcgtgggttgtctgttcgtctgccctgcgtttttccgcggcttcccggattcgggatgtctgttcatccggccggtggatctggcggatatcggatacttccgcggaggacgcgcggttatggtaagacaagactctttccctcatctttttgaggaagtagtcttcatttttctcctcgggcgccatctccgcggtttcctgctttcctgcggtcattggcgagcgtttatccgacacggcacctgccttgggtcttagtaagaacggactcccggatggagcctcttctgcagcctttggaggttccgggacatccacgacgggaatcagttccggttccagcagagttctgtgcaccgcttcatagactgtgttatagacttcctgctgtctctggaaccgaagttccatctttgtgggatgaacgtttacatctatatcttcaccattaatatggaagtgtaatacaacaaaaggaaatttatgctgcataacaaaatctcggtatgcatcctcaatagccttggagatcatggcgctctttacatatctgccatttacaaaaaagttttcgaaattccggttgccgcggctgatggtaggtttcccgagatagccggtaatttgtatcccgcctttcccgtaatccatctcaatcaaattggcggccacctcgcggccatagatgctgtagatcacatcttttaaccggccattacccgctgtccttaacttttcctgcccgttgttgatgaactggaaagacacttccggatgggaaagcgccaggcgcatcaacaggtcttgtatatggccagcctctgtcataggggtcttcaggaactttcttctggccggaacattatagaaaagctggcgtatcaggaaggtcgtcccatccggagcgcctgtatcctctatcaactgttctttgccgccctcaataagataacgggttcccaaagtatcttctctcctcttcgtaatcaattccacctgcgtaactgcagcaatactggaaagggcctctccgcggaatcccagggattcgatgtgcgaaaggtcttcaaccgcccggatcttgcttgtagaatgcctaagaaaagcatttggcacgtcctcacggagtattccgtcaccattatccatgatccggataaaagaaataccgccctcctgtatctccactacaacggcagtagcacgggcatcaatggcattttccaccagttccttcacaatagaggccggacgctcaatcacctccccggcagcgatcttatcaattgtaatctgatccaatacctgaatatgtggcatagcttctctccttttccgccataggggtctgccccttatgcaaagggggctttcccctttgcaagaggggcagacccctttgcttttaccagcggtttttcagtttgttttgcaatctgtatatcgtgtttaatgcatcaatcggggtcaggttcccaacatcaatatttttcaattcttccaggacatctccgtctttgaccgtatcaaacagagacatctgggcgatgtcaacttcatcatattttttgaccttggatttctttttgctctcatgttctttgacggcaatttcgctgactcttgtggtgatatcctcatcactgagttcttcaacaatctcttttgccctttctatgacaatgtccggcactcccgcaagtttggctacctggatcccatagctcttgtctgccccgcctttcacgattttgcgcaggaaaacgatgtcgtctcccttttcttttaccgcaatacagtaattgttcacgttttctatcttgccttccagctcggtcagctcatggtagtgtgtcgcaaacagtgtttttgctcccagcagatgcgtgtcggagatatactccacaacagcccatgcgatggagagtccgtcgaatgtgctggttccccttccgatttcgtccaggataagcaagcttttgctggttgcattacgcaggatattggcaacctctgtcatctcgaccataaacgtactctgtccggaagcgagatcatctgatgccccaaccctggtaaagatcctgtctaccagcccgatattggcgctggatgccggaacaaaggaacccagctgcgccatcaaaacgatcagtgcggcctgccgcatgtaagtggacttaccggccatattcggtccggtgatgatggaaatcctctgttttttatcatccagataggtatcgtttgagatgaacatatcattgggaatcatcttttccacgaccgggtgccgtccgtccttgatgtcgattacgcccttttcgttaattttagggcgcacataattattgcgttctgcaatcagggcaagggatgcaaacacgtccagcgccgccaccgccttggccgttttctggatgcgctcgacctccccggctatggtgccgcgcacgccgctgtaaagctcgtattccagtgcatacagcttgtcctccgcccccagtattgtgtcttccagttctttgagttccggtgtaatataacgttccgcattggcaagcgtctgctttcttgtataataatccggcacaagatctttataggaattggtcacctccagataatatccgaagactttgttgtacttaatcttcagattcttaataccggttttttcacgctcttcttcttccagcttagccagccagtcttttccgtctgacttggcgtgcctgagcgtatcgacctcctcgctgtagccgtcccgtataataccgccctctttcatcgcaagcggcggatcatctataaccgcatccttgatcagcgtacacaaatcttccagtgtatccagatcatcgcgcactcctcccagaagcgcggactgcatctcttcgagtatgtacttgatcggcggaagcatctccagcgaactgcacagcgcggtcaggtctcttggattggcagaaccgtaggtgatccgggtaatcaggcgttccaggtcatagaccggtgacaggtattcgcggatctcttcgcgtgagattgcattgttctttaattcctctaccgcatccaggcgccgcagaacctcctccttttctatcaaaggttgttccacatacttcctgagtgtccgggctcccatggcagtccgggtcttatccagtacccagagcagggaacctcttttttgcttttccctcagcgtctcgcatagttccagattccttctggtggaactgtccagcatcatatattttcccgtcgtataaggagtaatatgggtcaaatgggaaagattgtttttctgggtttccagcaaatactggaggagggctccggcgctgatgatcccgcagtcataatcctccagcccaagccctgcaaaggaggatacatgaaaatgctccagcagcttcttcctgcagactgcatcatcaaaataccaggcgtcaagagaatatatagcgatgcccagccggtttctcaggtcatccagatccatgccgctcatgtaaaaagattcattgcagatgatttcggagggcataaacttgtaaatctcatccatcagctttacgctgtcgggaagttctgttacaaaatagtctccggtcgtaatatcggagatggccaggccataacggtcggctatgtaaacgatacacatcagataattgttctttgtctcatccagtgcctgaggggccagattggttccgggggtgacaatccgcactacatcccgtttgacaagtcccttcgtcagtttgggatcctccatctgctcacagatggctaccttgtagccctttgcgaccaacttgttcaagtaattgtctacggcatgataagggacaccgcacatgggtgcccgctcctccagcccgcagcttttgcctgtcagcgtgatctccagttccctggatgccgtaatggcatcctcaaaaaacatctcataaaaatcgcctaatctatagaataaaatgcagtccggatactgattttttgtctccatatactgctgcatcatgggagttaattctgccacgtttctacttcctttcgcttctgaatttccattatagtataccattttttaaaaagttgtgaaagagaatttttctcaaagagccggcatgtgtttgtgaaatattacagtacgtgaaaatgcggttttgcctctccatacagccagtaaagcaggtatgccgccagaaagatcccgaacacgcttagtccggaaaataggatcgtaaagggcgcacatatctgtccgaacagttgaaaaggctgatccgaataatcccagacgttccagtgcagccacttattcactatgatcccggtgataaattctcccgccgtaacaaacagcacgcagcggactagctgcaaccaaagcggatcctcccattttacccagagtccctgctgtccaaagaaaacaaggcacagcccgcccagcataaacatggaccaatgtgaaaagcctctgaatatgacttcaaatgtataataaattgttccgcccagtgtccagagtaccaggtattcgctcacttttttcaccgaaaaaacgtcctcctatatatccattcgtatctgttatatatagtctggacgttttttattgaattataggtggaatatattgttactatgcagagctcataggccgtgcatagcagcaatttatttcttaatcatatcgccaatataataaaaacctctgcattcttttaattccacacttacaatctttccgatcagatcctcaccgccgggaaaatgaaccagcaggttattgctcattctgccggttacaagcgccgcatcgtggtcattgaccgtctcgacaagcacatcctggattgtattcgtgtatacactgcacacttctcccgatatactctgcacctcttttaagaggcggtcgaatctgtccttcaccacgctctccggaacttggtcttccataatcgccgcgggtgtgccggtcctcttggaatagataaaggtaaaggcgctgtcataacgtactttcctgaccacatccagagtttcctgaaaatcctcttctgtttcccctggaaaaccaacgataatatccgtagtcagagagatgtcaggcacagaagaccttattttttcaaccagctcaagataatgctcttttgtatagcggcggttcatcttttccagaatgcggctgcttccggactgtatcggaagatgaagatgccggcagatcttttcggagctgcccatcacttcgatcagttcgtcggagagatcctttgggtgggaggtcataaaacgaatccttttcagtccgtctattttttcaatctcccggagcagctgtgcaaaactcatgggctgttccaggttctttccgtaggagtttacattctgtcccagaagcattacttcgactactccgtcagccaccaattcctcgatctcacggatgatatcgtgtggattacggcttctctcccgccccctcacataggggacaatgcagtagctgcagaaattattgcagccgaacatgatattgacaccggatttgaacgaatactttctttcagcaggcagatcctctacgatcttatccgtatctttccatatatcaatgaccatgcgcccggattccaggcgggtagcaatcagttcagcaaatttatagatattgtgggtgccgaaaatcaaatccacaaaccgataactcttcttaagcttttctacgacttccggttcctgcatcatacaaccgcagagaccgatcagcatatgcggattcttttttttgacacggtttaactggccgagccttccgtacaccctctgattggcgttttccctgacggtgcaggtgttataaattacaaaatccgcttttccctcgtccgcttcctcacggtatccaatctgttccagtataccagccagtttctcagagtccctggcattcatctggcagccaaacgtgacaacgcaaaaagtcagaggatggcctgctttttcggcctgctccctgacgtattctcttgcttttgctataaaataatactgcctttccggttcccggacaggcggttcatctgataagttaatttttgaaaaatcaatagttttcatatgtaatattcctttacttatgccctggacagcagtcagacaaactggttccttgcggcatcatattcgtaatctatcattttcagcttcccggtcagttcttctgcggatatcgccaaatcatcgcatagttcgtccaatgattgataataatccctgagcttcgtattcacgacgctcagcaaaatgaccggatcgcccggaagtcctgtcagcatgtataaatctccttttctgttatgatacattcaggccggatatcgtgttcctcagaagggatcaggtccaggcattgtatctcataggccagcgctatgcggcggtattcgggatgctttccaagataagagtcataaaacccttttccgtatccaatgcggccgccccgcctgtcaaaagctacgccgggcataataaccagtacattgctgccggcggcttgtctctctgccggcggctcggagatcccataatacccttcagacagttcatccatactgtcaatataataaaacaccattctaagcccggagttatccacatggatcttaggaaccgcaacctttttccccattttccaggagtattccaccagccgcaacgtagacacttcctccccgaaagcgacataacaatagatctcctctgccttctgatacagaggatgcccaataacagccttaaaaatcctgtcgctgaaggcctgtctcatttcagcgggaagagaggccctgtcttttttaatccttgccctaatttccttttttgtttccaaacttttcacccagattcacaacagtcccatctttttcctcaatatcaatccgatcaagctggctgcgcagattctgcctgaaagaatccacatattcctggcgcaggattttctgttcctttttttcagattcggtaaggccttcggcttttgattttctgtataattcattgattcgtttaatcttttgttcgtccattcgtttctcctatttgcagatcattttctttcgcaaagctgcagaacaaagtatatattacactatttgacagatttcgtctacttatcagctcgaataattttctaaaaatccgtagagtgcctgctccgtctcgatcagttttccttccctgacttcctcctgcacatcttccggcaggtttgaaagtggaatacttgtaacttcataaattgttgtcttgtcattgaggtaaactacaatatatccatggagctcacaaatataatagccttcattctttgtggcgctcccttttgttgtaatgctttccgttttctgttccggaatttcagccttggcttcctgcctgtccagcatatactggtagctgagctggtagccaatccccagcatggaaacaagcagaaaaacgcctgcaaaaaagccaatacagtatttcattttcataaggaccgactccttttttcatacagtattggctttttttattgttctatacaatttttcgaaaaaattatcagttttttcggctgttgtttctaccgtccgccgtggggaagcagatgcagttttctgcagatcctcagtattttccgtccctggggcagatcacggatatcttccggtgaaagagcgcccaattttaagatgcttacggcgtatactgcaacggcagccaaaatcgaaaggatcgttggaatacggcctccgatcagcagatcaagcaccaggtgcacggcatatgttacaacacccatgatgacggctgcgagaagcggcttcacaaaagtcttttccatctcctggcggtgtccgtttgccttgtggatggccctgatatttaagatacacatgcaaagcgcaaacactatgttgctgcccacaagcgcgtaaatattccatttaaatacgatcagcataatcagcagggaaatgatatgtacaacaagtgatatccccgcattcttagcaggcacagatattttatccaggccctgcagcacggaatttgtaaccgtagataaacagtaaaatacaagtgtaatggagccgacggcgagaagcaatgccggtgtacggctggaatctccaaatagcagaaccatgatcggcgatgccagtaccacaaatcccacaaaacaggggattgctatgagcatcgtaaaccggacggactggttaatcttattatgaatctgcgggcggtcatttctggcaaccgctccggtcagactggggataatagatgccgccagcccgttggccatggcgagcggtacactgagcagtgtattatactttcccgaatagattcccagcagagccatgtatttttcttccggatacccctgcgcagccataattttattaaatattgtcatatccagtaactgattaatattgtaaatcgcagtactgaagataataggaacaagcgtaatcaggagaatcttcaggatccggccgtaactttcctgacggcgcgtcctgtccgtgcggagctgtctgcgtatgacaccgcggtatacaaaaaaggcaaacaacaggaagaaaagggcggaaagggctcctgcaattgttcccagcgttcctcctgcggctccgtatgccggtcccatcagatcgttattctgcttctccgccgcttttatcccgatcccaaaaaggatgcttgcgccagccaaactgataaccgcattgacaatctgctcaatcacctgtgatacggccgtgggtaccatggtaccaagcccttggaaatatccccgcagaacacctaagacggatacaataaaaagcccgggcgccagaaccttcaaggcataagcgctgagcggcgattccataatgtgagaggaaatcagatctgctccaaagaaaatgatgagggcaaatacagccccaatcacaatggaaaacaccagggagcatacaaatacgcggaatgcatttcttctctgcctcatagccatcctcgcggagacaagctttgagactacggtaggaaggctcagggaagatagaagcagcgccagtgcatagacttcgaacgcatacccgtaaaatcccatcccttcatcccccagaatatttgtcaggggaattctatatacaacaccaatgattttcgtgatgactccggcaatcgccaggatcgcaccctgcattagaaaatcatcttttctctttttttgcttatgtgactcagccataagttccctccgtgtaactgttccgtttacttagctaagagtgtggtagataatccttgcgccaatgtaaaacacaccctaccgcaatatctgaatattttcaagaatttctctctgcttctgttccattagaagacgttcttcctcctccatatggtcatatccaaataagtgcagcatgctgtgggcaatcagaaaagcgaactctctgcgcggagaatgtccgtaagcctctgcctgttcaaggactttatcttttgatatgacgatgtcccccagcatcagttccccggattccgggttaaagcagtcctgggaatgctcttccatccccgaaaaatcaccgggcgtcttatactccagcatcggaaaagacagcacgtccgtcgctttgtctatctggcggaacatctggttcatgtcccggatatcttcgtccgtggtcagcagcagattaatctcagcctcatacggacagccttcgtattccagcgccgcctcaatcacaagatttgctgtatcttctgtattgaaaggcagcttcaggccgccttcttcttccatgtataaactcatgagttactcctttacaaactgtttgccggttcgaattttattcgctttatttccaattctttacatacaaactccagcctattatacacctcatttcactcccttgtaaagttgctttttttgtaaagcttcctatcctgaaattgcaggttactgttcagaccgtgccgtgcccccccccccccgctgcacagcatcggaaccgatgaagtgatggtctcggggcatccgcctcccgccgtaggcgactttaaatgggcagatgccgttactgttcacgcccgcagagtgtgcacagtaacctttgcagataatgaaaaagatacagccgggatatctttccccggatgtatctttttcattccttttacactatctagtcttcggaccggatccgatccgtttcttgtcacgccttgcctgggtacgttcttcttctttttcaaatgcctttacaatatctttcacgatcttattgcggactacgtcacggtttgataacttcgcaacggtgatgtcatcgatgccgcccagaatccgggcgcatctttccagaccagaatctgtattcctaggaaggtcaatctgggttacatcaccagtcagtaccatctttgagccttcgccaaggcgcgtcagcgccatcttgagcgtggaaaatgacgcattttgactttcgtcaattatcacgcgtgcccggcttaaggtacggcctctcatatatgccaggggagcgatctcgatctcaccgcgctcctgatgtttctctgatttttcgcgtccgaatatatcgtccagggcatcgtacagcggtctcagataggggtctaccttctgcgccaaatctccgggcagaaatcccagacgctcttctcccgcttctatcgccggcctgctcataataatcttatcgatttccccccgttttaattcttccgctgcctgggcaacggcgaggtatgtttttccggttccggcagggccgatacagaaagtgacgatattttcctttaacgcttttacatagttcttctgtccaagagtcttacacttcacggggccatgtttataagtcagggtaactacatcctgcatggctttataagtttcatcgagtcctccatccctggattcctcgatcagacggtgtacggtatcttccgtcagcgcagcgccgccggtgtggagctgtttcatgcattctaaaacctctttcacacagttgacatcaatctctgattcacctgtgacctccagcatggaatcgcggcctacaatactcacatgaaagctgttttcaattagcttaatatatttatcctccggcccaaaaacggcctgctgttgattgatggtgtcaaacgacagttgttccttctgcaaacgataatacctcgctttcgtgatttggatatagcacaagaagtattatagtggaatcaacctgttttttcaagtatatcggaccacgttttaatttctgtttcatcggtaatccaatattcaaggttcaatatgccggataaacgcctgcattttcagaacctgcacatctccacgcccgtgctccccgctgctgcatacagcctttccatcagcaaatcggagggaggcgtcaggttttctaaaggataccgccttcccagtgccttatacttgcctctcccaagcttatggtacggaagcagttcatatccggccacagcagaagctccggcgctttttatgaattctccgattgcgcgtatttcctcctccgagtcattaaagccgggaataatgggagttctggcgatcaggtcaaaggaatactttcgtgacatctccgccatcagaagaaatctatccagtatcagcttgtttccggagccggtccattgctgatgtttcatgtcatccatgcactttatatcgaaaaacaccatgtctgtataaggcgcaattctttcgatcgtctctgccttccccgacccacaggtctcgattgctgtgttgatccagctttccttaagagactgcagcagtgcttccagaaattccggctgggcaagtggttcccctccggaaattgtaacgccgccgccgcttttcagataaaagttcatgtcccgtttcaccagtgctgtcacattccctgcagtcatctcttctccactgattttcctgcatcccgcgaagcactgctccacacagggaaatggagattcccggtctgcgcagttactgcagatattcctgtccccggcaggtgctgtttttaacgctccataaggacagctttccatgcaggcgccgcatgcaatacaattgtcctcaaaaaacatgagttccttcttattattttgtgtttccgggttgcagcaccatctgcacctcagggggcagcctttcagaaagactgtggtccgcactccaagtccgtcgttaagggcatacctctcaatattggctacaaggccgcttttttttgctgtacttccgtaaactgaacctgtcatgatcctgtccccctgcatttagtcattccgattagcaaggacagccgctacaatgataattcccttgaagaccatctgcggataggatgcaattcccaaaaggttcattacattcatcagaattcccatcagaaatgcaccgatcagagtctttaccgcacctcctgtgcctcctgataaggatgctcctccaatcacaacggatgcgatggcatccagctcatatccatcgcctacggttgctgtacccatgctcagacgtcccgcaagaatcatcccggccagtccaaacagaaatccaccgatagcatatactgccacaagatatccttttacattgatacctgccagcctggcggtctcctgattaccgccgatggcgtaaagccctcttccatatttcgttttatttagtacaaaaagtacaattaaaaataccaataccatgataaaaatcggagttggaataaataatacagacccctggataaaatccggccagaatgtcccgtcaattctccgattctctcctacctgatacatatacgcaaggcctttcagaattgatgtcatggcaagtgtcacgataaacggagctaccttagcataagcgaccagaactccggtcacacagccgaataaaatccctaatccgcctactgccgcaatggccatcggccccatcccattctgaatgaaacctgctgtcagacagacacaaatacatacatacgagccgactgaaaggtcaatcccgcccgtgatgataatcatgagcattcccagcgcacagattgcagaaatagagttcgtgatcaggactgatgtaatattccctactgttaaaaatacaggtgtcgcaaaacaactgaatataaatataagaataaaggcaataattacaaaattattcttaataaatttccctgctttgaaatgacctgtttttccggcaataatcttttccattttttgattcctcctcacctatctctgctcattcacagtgttggttgcatatttcataatgttttcttctgtcagcatttcttttttcagctcccctgtcaggttcccttcgctcatgatatagacgcggtcgctcataccgattacttcaggcaggtcggaagagatcataataatagccactccggcttttgccagttccttcataattgtgtaaatctcaaattttgcgcccacgtcaaccccgcgtgtcggctcgtccaatattaagatcctggggtctgtcgccagccattttgccaatacgactttttgctgattgcctccacttaagcttttgaccggattatgcatgcctgccgacttgatccccagatctttgataaacttctctgtaagggagctctctttcttttgattcagcatacgtcttgtgcggattttatccagcgctgcaagagttaaattaaaacacagggatttatctacaatcaacccgttcccttttcggtcctctgttacgaatccgataccggatcggatcgcctcttttggacatttaaagagtatctccttaccatccagttttaacttcccttttcctgtaattctgtagccgcctgtcaccgccatcataagctccgtccgtccggcccccaaaagccccgagattcctacaatttcccctcttctgaattccatgctgacatggtttacgatatgtttcccgtcatattccggatgaggcacgctgtagtccagaatctccagaataacatcgcccttttctgtctctatatcaggatacatattctttaattcccggccaatcatataagacacaagccgatctgttgtcagttcgcctgtctttttcgtcacaatcattttcccgtctctcatgaccgaaacagaatccgtaagtttaaaaatctcctccagcctgtggctgatatagatgatcgtaattccctcatttttcagttccttcaggattcggaacagggtctctgtctcacggtctgtaagcggggctgtcggttcatccagaatcagtacccttccgcccatcataatcgccttggcaatttcaaccagctgctgctggccaacgcttaaatactttacctttgatttcacatcaatgtccagtgacagccgctttaatgcatcttccgcttttttaaagacggttttccagtcaatccccgtatgatttcgcggcatatgccccagaaatacgttctcagcaacactgatctcagggatcattgccaattcctgatgtaccatgacaattcccgccctgttcgcatcatcaggacttaaaagcttcacctgcttccctcccacaagaacatctccctcatatgtatgatgtgaaaagcttccgcttaatacattcatcagcgtagatttccctgcaccgttctcgccgatcagtgcatgaatgtccccttcctcgatttgaagggaaacatcatctattgctttcactccggagaatgcctttgttatatgtctcatttcaactgcaaatcccatacctaaccacctctttccctttacttaaaggcaaatcctttgataaggtaaaagaccgccctttggcggccttttccttttaatatgtggagtccggatcgtaaacatcgtccacattactcttcgtataacatgtattcggtacgttaaacgtcgccggcgtagtgacaccggatgcctgctgtgcagcaaggtataccgcccattttcccataattctcgggtcgttggatacggttgacgcaacccctttgtcaccgtctttaatccatttcaggaccgattttcttccatcaattgatgtgatcataatcttcccagtcttgccggccgactctattgcagatacaactccctggcatccgccgtcacatgcactgaaaataatgtccagatctggatttgcctgcagaacatctgttgtcactgtcattgcgggctctggctgccagttatagtactggtatgcaacaatatccagatttgattttccatacttttcgagcatatagtcattgtagccgttgatctgcccccatcttctcaaatcagactctttttcctgcgctgccgcggatagtacaagtgcttttacagaatccttccatccatatttttcgtcaaatgcctttgccagttcaaagccgccctgatatccgctgttctctacatcagcggagacaaatgtaaaaggcgccgcctcttcactcattgcactgtttacgactgtcagcggtattcctgcattatgtactttctcgattgcaggaagaagccctgatgaatccttcggatttacaataattgcgtccattttcatatttaccgcagtttcaatatcacccatctgttttgtaatatcatcttccccatcgtatacggtcagtttcacgcctaagtgctccgcttctagctgtgccacccttacaagctgttcataccattccgagcctgcaatatttctttgagaaagcgcaatctgcaatccttcgaattcattttcttctccaatcggctcttccggcagcgtattcagcatttcattagttggtgagaagctttctcctgttgcattacttgcctgtgtactttttgtctctgtactctttttctggcttgccggctgacaggctgctaaagtccccattacgcatatacacataaatatactcattatcctttttttcatctctttttcctcccattcttcttctccgcccgcagggcatatgttacggggtgcccttgggtatacattattctgcagctttgctgcaaatccgcccgcagggcatgtgttgcggggtgccctacgggtataatttttcttcagttctttcgataatatcttgctggacatcccttgacagctgtgtaaaatacgcgctgtatcctgctacacgtacaagcaggtctgcatattcctgcggattcttctgggctgcaagcaaggtatctctgctcacgatattaaactgcatctgtgcaccgccggaagcaaaatattcgtctatcagacttacaaatcttctgagtccgtcattttttactaccctttccataatacacctcctcacattttccaacctgcatttaaattcagcaagacctctatccggccttttggaatactaatacaggtcagacggattaaatttcaaattatacaatgaaccgcaggaaagtaatatattgttaatctttgacacagaacggattgccgcagtaggaccactcgtatcagttcctttcatcggggactgtccatctgccaccgcagtgtaagcttcccgtccgtccggagtcgcgccgcacaccttaccgaacggagtgttgcttgacacggtgctcgtagagcagtgaagcgtgcctccaattggaccacggccataccttgtgtttttataggagcataactcatttgctacaaacgcaagcatctccctcgccagttcatctacttcatcaatgtcattcccatacttttcaacgcctttgcacagagcctgaatctgcgggcctgtcggcctgctctccatatcctgaaaattggtttccaaagcatgcttaagctgcgcgccggtcagtctcttatcgtcaaatatcagtttcttaaccgcataaagactattggcaatattagcggtcccaatggtctgctgtcctgtgaaatcatactttgcaccgccctgcttaaacgtcttcccgcgctccagcgtcgtcgtcggacagccaaatacagaggtcatcggctcattcatatgttcttcccagagctggtcaatcgtattttccagaatcgcctccatcttgatataatactgaatctgatccttatatgcttccttcacttcctcgaagctctcaaaggaggccaggttttttccgtttttattcgggtggaggcagataccggttctcggatccgttccattatacagcgacatctccagcgctttcgtacagttcagccatgctccgccggttctgcctcccaaaagccctgccggtcccggttccacacatccaatgatacagtaattataagcatcgttcagctcatacccccgattcagaagcgccgggatatatgtctcatcattaaagatagacggaagccctgttccaagcctcaccacttctgctgtcttcattttgaattcaaaaggtgtgtttttatggaaacgcacggtcagcgacggctgcggtattcttgtatggtagatggcatctaaacagatgtaactgagttcattcgttgcatcgcattttctcaccggatcctgtccgccgatcgtaagattctggaacatcggtactccccggaaataatctgtatcctgccagcttcttactttgttgcttgcataaatctgcaggaaaaagttttctaccatttcaaccgcctgttcccgttctaaacgtccttcggcaatatctttttcataaaatggatacataaactggtcaaaccgcccgaaggaaattcctacaccattatcctctatatgcagacagatatgggtgataatgataaactgaagcgcttctttgaaggttctggccggttttgcaggaacatgggtgcacatttctgctatttcttccaattcctttttcctgaccgggtcagcttcttttgctgccatccgggctgcaagctctgcatatcttgccgcataatgaatgaccgaattggccgttacaatcgcagcttcgtaaaaatcctttttcttaactgcttcgggatcatttttccagtccagatgatcaagcccctgccctgcaagatgaatcatttcttcaaggccgtggttaatcagccattcatgtgctgtagcaaagtgtccgtcaccgccctgaaaatatgcccctatatctgcagcttttatctcatagtgggtcaggagcgcctcttttggaagcctgtttctaagcctgtccacatgcgttttgcccttccaccaatcacatatatggcgaatgtcatccatatcttccctgcgcagaacgtatctgtctgccggtcttgtatctgggaaatatggatttcctttgataaattcctcctccatccactccacttcaaactccggaaaaatgggcgcccaacgggggttggaggtttggttgcctgcaaacaggctccccggcatcatgtagatactcatattctttaatacatgttcaatcgcgcgtgcccgtttcagtacattcggcagatccggttctgtctcataaaattctgtcagatattttcctctctctatgcagataccgctttcaaaagaagtaatatacctgtataattcatcaatccgctttgatctcactggcttcgtactgatttgatacgaaaggttctcttccatatatttcctcctgttattttatgtacatctatggtttctcgatatatcgttcttcctgcaattattatatttgttattatattctgcttcaactcattatctttggtaaaaagaggattttctttagttttttgtatcttttgtatggttttgatatctttttcttttattaattgtgttttttcactacatctattgaaatctctggtacaatccattatactgattccaatctggtagagaatatttaagggggaggaattatatgttaaaagttctgattatagatgatgaagaaaaggtctgcagactgatccagtgcctgattgactgggagtcactcggcctgtatatcgcaggtatatgccatgacgggctgctggccctggatatggtaaaagaaacttctccggacattatcattaccgatatccgaatgcccggatgtgatggacttaccctgatacgggccgcgaaagaattcaatcccgggatccattttattattatcagcggttatgggcagtttgactacgcacagcgtgcgattcaatacggtgtttctgattatatattaaaaccaatcaaagaaaaagacctgaaggcaacactagtctcaatcgtagaaaagcaccagtcaatggaatcgcacaggcagcaggatgaagcaatccgaaatgagttaaattcgactcaggaacgcatcaaatccaatttcatcaatgatctgattttaaacccgcagatcatacaggccttccattccattgaagatatcaaccggacttattacaccaattttaaggaatctgcttttactctgctttgcatttatcttgacacccctgatgagaatggccggacaattgtcagtgattttctggtaaataaagcagccgggatcattgattcagaaacaggtcagtatcatgactgttccatgaccgtttccggcggatacatatattgccttgtcaatgacaatgaagaacagctgtcacacatttaccagacttccaaaagcatccggggagccctgctgtcattaaaagaaatctttcctgaacttcatgttatactgcttcaaagcagtattaagcacacttttgcagaaatcaccgattgttttggggagatagaatctgcactgtgtgaaaaagtcctctcagggagcgatgccatttattcctattccaggataccgaaatgtaaaagccatgtgtcggactttatcacaccctctttcagaagccagtatctcagctatgccgagacattccagtacgaaaagctgcaggaatttctgtctgatcttgcgaatcggcttgtccttctggacgctgttaccggtgcgttcatccggcgtgtatacaatgaaattgtcacactctttttattctgcctgaatcagcataaaatcaatgtatcttcggacgagctgaccgataaatggaatacctgctttctttcctttacttctgtttatgatttgttttcttatctcgccgaagaacaatgtgctttgcttcaggactggaaatctcataagaagaaagcacagtccaaagctgtacttatggcgaaacaatatatcaacgggcattatgagcaaagcctgacactggaacagatcgggcaggtagtcggtcttaacgcttcttatttttcaaatatctttaagaaggagaccggaagcagctttattgaatacctgacagatgtccgcatccagaacgccaaagacctgctcacagagacagatctggaaatcattgagatatccgaacgtaccggcttccatgacctgaaatatttcataaggtgcttccgcaagactaccggaatgactcctgccgcttaccgaaaacttttttcctgacatacgggtgagatcatgaaaaaaacttattatcatatactttgtacactctctgtcattctggttgtgttatccgacattgccatctgtctgacagtgatcccagggaatatttcttatacagcactcttctttttactggcggcagtccatatagcattatttgtttatatttggtattttctccgaaggccgcagaaaatactaaaagaagctgccagggattataattccatgcaagattttgatgcctttctggcatctgcttcaccctttttgtcggaagagctgctgaacatgatgtatgattttaaacatcagaaaatagacttcgcaaagtctcaaaaacaggcggaatatcttgctctgcagaaccagattaatccgcattttttgtacaatacattggaagccctgcggggcgatacattgtacgagggactgaaaaccgtttcatcggtcattgaggcactggctacctttttccgttatacaattaccgataccggcaatctgactacgatggagaatgaattggatcatacagagaattactttatcatccagaaataccggtttggagataaaatcaatatggatgtgatctggccggatgacagaaacgaggttcttaccctgcttattcccaaactgactctccagccaatcatcgaaaattcaatcttccacgggcttgaaaaaaagagcgggaatgggaaaattacgatttcgatcgaaacaacagaacggtttctgttcattaatatctcggacaccggtattggcatgacgcacgatattctgcatcggatcaatgaatctcttgaaaatccgtccaggcccccggcccccacaggaaaacaggagcgccagagtattgcgcttcagaatgtggcacgcagaataaaacttctgttcggcaatgaatacggcctgcacgtatacagtactcagggaatcggaactgatgtccgtatcatcctgcccaaaatacagaaaaggaacctgactctatgaaaaaggaattatttcgtatcttcaacctgtcgattcgccagaatcaaagcgcagtcctttcgaacctctatctgcaggtttttgaaggggaacataccggaattctttttaatagtttttatgagagaacagccttcttagattttattgatggtaaaattccggaagtagaaggaatcatttattttgaagagactgccgttacatatcaggattatatccgttcatataaaaaggaaactgcaatcgtctatgagtccagccgtctgatgaacagcctttccgtatatgaaaatctattttatgaacggctttcatttttatggattacggctaaaaagtataaaaaaatggcagaaaacctgttcgaattttttcacctttctttggatgttaatcaaaaagtgaagtcgctgaccaattttgaacgaattgctgttgagctggtgaaagcatttctgcagggaaagaaactgatctttttatcgaatgccgcctctcttttagatgccggtgaattcgaacagcttttatctattctcagagtattggaaaagcacggtatcacgttcctaatcggggagacttttgatatccgtctctttcggcttacgtgtacgcttcatctgataaagaacggacagaccctccgaattctgccgcgctcgcagatctgccaggaagagattcaaaggtcgctgggctcctattctgttcttcgtcatcagaagagccatcatcaggacagggatatcagagaatccgttctggccttcgaaaatgtgcaggatatattgcctgtcccgctgtcgtttacactgaaaaaggggcagattctgaaaatcatctgttccagtaaccgcgaaacagattatctcttatcgattttgagacggaaggtatcagccggcagcggaactatacttttcaggggacagcctctgcagtctgtctccctgaaacagtatctgaaaagctgcggaatcatagaatccaatccgcgccggaccgtacttttccacaacatgaccgtgctgtataacctctgtgtaccgcttgacagcaaaatccataatttctggaccaatccaggcaatcaaaagggagttgaatatacgcttaaggatattattcctcccggatatctccagatgaatatcgatcaggtaccaatggaaattgtacagaaagtcatctactgccgttggcttttatatgtacccgaattactggtctgcatgaaccctttttccattatagatacctccttaaaccggattacgctggatatgctgaggctgctctcttccaaaggaatcgccgtgctgattatttctaataactggactatggatacagaaatagaaggggaggctgtatttttaacacaagaataaataacaggaaagaatgctaacagttcagacaggactgaactgatacgtaggatgattattcttgtggcacgccggtctcctcctgtccctcactttcaatctctataatttccgtatccgcctcctgtgtgattctttcattgagatacaaaattccttttgcaacagctgtatttttgcttatatgtattttgacactgttttcccggatctggacgtcattttcctccaattccttggaaaactgcttaaagttactactcaactgtttttgaagctcttcttttgtgtatggtttctcttttgaagtataggatcttacaattttgctgccataggatatcggaagataaaagttctcgcccagcttgagttgatgctcattggtatacatctcccactctttgtaatcattttttacagttcccgcggagatgtaccaggaacctgcctttatataatacagccgacgctgtgacttttcataatatttctttttatacgttgtgctgatcgagtcctcgtaattcagctgcgtatctgcaaatatatcggcgtcggacttctgatactggtaaccggtcacttcccctgcgtcattgagcacctctatcctgccggttacaagtacatcccctttcgccacggtgtcgcccacatgaacctgtggaattccggatcttgtaataatgctggtgatcacgccatcctttgtggctatcagatcgctgggcgtctccgtttcctttcccgcatccaaagatgcatccccctggccttctgctcccgcaccatcggcactttctgcctcttcccggaaagtgtcctcattctccttaatctggatgcgcagccggcttccatctatggaggcggatacccagacaatatcgtcatactcttttcggatatcttttacaatctgcgcgcagtctactttcctttttgccatatgcggggacacgtctttcgtctcaagaaattccaataaagtttcgtttgtccatttttcattgccctcaaaatggatatcccatataaaactcgaataaaaatataagaggccaagacaaaggataaagctgataaaaaaaagctttcgctttctgtatttatgcagaaagaaaggaagaccgtttctctggacaagtaaaacttttgtatgagtcttcctgacaatcggcctgagtctgcggaatcccttcaggctcatatacatttcgtatgcattcccgcagggattcagcccccatatatagatctggtgatggcggcacaggttcaggaaacgttccggggaatagccttccacccggatttttacatacccgtgcatatagcgaatgattgactgaatcactgtttccttacctcacttacaatattctagtgataaaattctgcctgttattttcatctcatcattcgtataatattcgatctgcagattctttccctgcagcctgatctgatatcccttggtctgtacacgaatcaggacatccgtgtactctataatgccccggtaattctcaatgcagacttctcctgcccctatgatggtcacaacagccgctccgaggactacgtcttttggcatgctggctgcagaggccagcttttcctttattttttcattttctatttctcttcccatatagaaatgccacacatacgccctttatttgtagtatatgtgcggcatttttgtcctattcggctaacagttatgttttatcccacggaagcggcggacataagactcccacctctataggtggcgagtaagtaacaatttcgtcttggtgggagtccaatctccatccaagataaagccgccggcagatggcagagacgcgcagatgtatgatatcatgcggagcatgacgcgcatctcgccgcaagtacgccttggcgtacttgaatgaatcactttcgtccccttataaatatcccggctgcgatgagtatcataccgcccgcaaacagccagaatttttccgcatagctgccctgggccatggaaaacgggtaaaatactttcagatattttgccccgcttccaaaagcgacgatatagtaaaagacagggatcatataaccagcaatcagattgtcgaacagagcgaaaccaaatatccccagccctcctacaaacagcatttcggccagggtgcctccgtagtatgggagtacatggagctgacagctgttgtatgaaagcaccgccatgtaagcgcccagcaggagtgcaagcagtatgactgcttccagcacacggatgccgtatatcgctgtaattttcgtatattttgaacggatcaggtcacggaggtccggattctgttccggcagaaacaccggcgtcagcataatgatgccgagcagcgccacatagcgttccagcacttttgcagcatcctcatagggcagattctccacgcccagtacaagcggagaaaagcagagcagaaggatggcaataatggcatgaacgggtatattatgccttgtgttttcttttaagatttccaaatattttgccacggatatccagcctcccttttcttttttgtgtataaataaaaattgatattactaacaggagaagagaaattgccgcgtaaagccctctgtttgctgctagctgaccaaagttttcatgaaaacccgtataattatagaccgtattgtgccttggtacgaggctccatccatatgcacccccgtgcatactgttcacagatccgaagattgtcaggaaccaccaggctatctgaaccaggaccccgagcgcagtatccgtcagttcagtcagtaccagccctactcctgcggaagccattacagttggaagaagccagccgaagctgtatttgacaaatgccagaacatccatctggatcccggcgccggcggcagactgtaagcactgaaccagcgggatacaggataacaggagcaccggaaccatgatcataatcagcatggcagcataccggcttgtgatgatacaggcagaggatgccttcctgctggcaatcagttcctgcatctttgagcgtctgtcacgcagcccgcgggtcactgccagaaagaccggcagaataccgagcagaattcccatatagtcactaaacagtctcgcataaccaccggtgagatggtcgttttctatcaggctattatagtcttccagagcctcctcatatgtctttggctgggagacgcttgtctccaggctgtctggcgcatagtaagagcctccgcccagcatatcgtcgacttcctgcattaactcttgaaaccgttcatacgtcaaccctttttttacctgtgtggggctgctgccgtatatcacctggacgccgccttctgcctcctgtattgcatccgcaatatcgccttcccccgaaagccctgtggtctcctccacaatctcgccaatccgcttctgttccgcttcgcttggagtgacagacttataaaaaccgattggataggtggtatatgttcctgccaggtattccgaaacaaggcgtccgagtacagattccatgatatccgtctcattccctccatatgtccatccgtaattttcctgccccggctcaggcttttcacctatcgtcattcctcccatctgggaaaaataaaagactacaaggatcaccacgatcagccagtagatcatactcttcattgtctgccggcattcttttgctaatagactcaggaacatcagagatcaccccgctctccgtgcatgagatacatgtaggcatcttccactcccgcctcacagcactctgcatgtgcaaatggtttcttttcggcaataaaacgaaccattacgttattcccaagcgtcagcatgctggtgacaacataacgttccttcagccgcggaagctcggatttgctgatctgggccgtgtagactcttccgtccgccatatcaatcagatccgagactgtaccctgatagaggatctcgccctcatttaacaccgcaatctgctcgcacgtagcttcgatatctccgacaatatgtgtggacagaatgacaatgcgctcctgggcaatttcgctcagcagattgcgaaaccggactctctcctcgggatccaggcctgctgtaggctcatctacgatcagcaccttcggattgtggagaatggcctgtgcgatcccaagccggcgcctcattccgccggacaatgcctttacctttttcttttgatcctccaggaggttcacctgggacagaagctttggtatcagttctctgcgtttccggcttccaagcccggacagtacgcccagataatccattgcctcgtaaacggtcatattcgggtacatggaaaattcctggggcagatatccggtgatcctgcgcactctcgccgcatcctccaccggaataccgcagacagagacgcttccctctgtctttggcaggagcgttgcaagcactttcatcagcgtggtcttgccggcgccgtttctgccaagcaggccgaacatccccttgtggattgtaaggcttacatcttttaaggcacattttcgtccataatattgatttaaatgttcaattttaatttctgcagacatttttctcatcctctctttatgccattctctgctccccaagggcatggattacggagtgccctttgggtatacattgtactgcagcaaagctgcagacccgcccgcagggcatgggttacggggtgccctttgggtatgcatatatattagcccgaaaatgtctacactttctctacaaaaacttaagaatgtcttcattcattcttacaggaaaatgaagccgtcacaacggcgccttgatcgatactgttagcaatgctcagcgttccttcatgtttcgcacagatatggctgcagatatggagcccaatgccaaaatgtggatcttcctccccgtctgcagcatcggaagccctgtgttctttataatagggattcaatgcattctgaagatccccctgggtgaaacctgggccgtcgtcatgcacggtaagcacaagaaccgcctttttatactcaaaatccagccgaacccagattctgttttccgcatagcggattgcatttgaaagcagattctccaatacctccaggatcaggccagtgtctgcgaaaagtatttcatcctcacttttcttagcgggtactgataaggtaatctgtatatctccaatctgattcagagaaaaaatgacttcgcggatctcattttctattctggataaatcacttttttctctgtgcaccgggagctcatctatgctgcggatacctttcattgtccggctgtactgttccaggcggttcagatgtgaggacatcagatgcagcgtgtccagcatcttttcttcatttactttgccctgcggaatatagcgggcaagaaagtcggaatatcccttcagaacggttaagggcgtccgcaggtcgtgggcgaaagccgcattgagctgcttctggtttcccacaagttcccacatcatctgcttattatgtatgagttcctgcttcatatcatcaaaggagcggcagagttcacccatttcgtcccggctgtcatacgtcaggtcaaaatccagattattgttcctgacggcctccgtcccctcctgtagaatccgaaggggggccgaaagcctccttctataaaatatcctgcaggccagaatggagcccacaagggtatatagaaacggacaccaggtacgaacaaaatccagcagcttcactagcacgctgtcacgggacgataaactggaaaaggtctgtgtccagaatggccagcccgacagcttcacactgtataaccatatatcctcaccgctgttatagctttgcaggatcctgctctcccactgaaaacagaagataattgtgacataagaaagaaacatagcggctgcggccgccactagtatataagcagttatagcagtgcagaaacgtgtgtttcttattctcattctcgtgtgttctatcttttcttctaaccaatccatttataaccaactccccatacagtttcaatatactgaatatcggtgactgctgacagcttcgaccggattcggcgtatatgttccgttacaatactgctgtccccttccccgtcatagccgcggactctgtcgtaaacctgttctcttgtgaatacctggccgacgtgcatggacaacagttccacaatattaaactctgtcttcgtcagattcaatgccttcccgtcataatatacacaacgttctgtataatgtatggcaaggcctccctgcatcttaaccgcctgtacttttgtcctgcgttcttctctgcgcagatgtgcctcaaccctggccccaactcatcaatactgaaaggcttcaatatgtaatcatccccgcccagcataagccctctgatccgatcctgttcttccaccttagccgtcagaaacaagatggggcaggatacatggtcacggatcatcctacagacttcaaacccgtcaagcccaggcatattcacatccagcagaatcaaatcaggcctgcgtgaggactgctccagcgcctccacaccattgaaggcactggcgacctcatacccctgaatttcaaaataatcttttaacagctgcacaatccccggttcatcgtccgcaactaaaatttttttactcataagccttaaacctctccattacaacataataacattttattataccggataaatctctacaaaaaccctataatcccagatgaaattgatttttcaatattcccgtcagcatctcctcatccacccctgtatacaatttcccatcaatcagcagattaggagccgttccgcagtgtttcaaacagctctgtgtgcgaacccgcaccttcccatccctggaaatcccattccgccgcaccttcaaaactttctgcagaaacgaaagaatatcccgtcccccctgatccgcacaggccttccccatacagacaacaatatcatgcagaaaagccgcctccttcaatgtaggatacatccgaaccaaagcccttataaaagaaggcttcaccccagtcaccgcagccgcccgctcaataaccccagccgtaatacacccataaatatcctgcagctcccgcaacaaagccacaattaactcctgctcccctcgattatccatccccccataataagccaaaatttcctcactcttccgttcccgttccaattcatccatatattcacaccccaaatcctaatttatacatcagtataccccgttcccgtaaattttaattaccaagagaacaaatgaattcctaaagataaaatccccgtcggcatctcataaaaaccatccaccaaaacacaagcctaacattcctatcagttaattgcctcaccaaaatccgcgaagccatccccaatccgcctctgccgccactgttcccacaaaggaaaaaatccagccgccctgatgcgccagcgccgaagatggacaggcggtacggtgtgcaggaagtgggcggcggtgtgctattgctagagtgcatttacgaattcttgaagaagtcaggcggaaaacagggggaaatccgtgattccgaatcacggatttggatgactcagcgtgaaaaattatcaaaatttttcacactgtgtcatccgtacccctgttttccgcctgacttcttcttagaattcgttaataaacgggtgcaatagcaaaccgccgcccacttcctgcacaccgtaccgtctgtccgtcttcggcgcgtccccatacccgccacatttatttcatttcaaaacaccctctaaccggctgatgatccgtgtattcaaattgtatatctatattttctacctgttccacatttatattatctgatacgataaacccatccagcacatacacctgtgattcctcataattcccgctgtaaggcccattcagaagcctgcaggtcggcgcattatcggacactgcgtaggaaaatcccgttggtatctcttccttccccacaatcccgggtacccagctgtctttattatggataggatatgtatccatgccctcgaaggtctggttaaaatcacctccggcaatgacataatttcctttttcatattctgactgtaacttttcagcgagaattttgctctgtgctatctttccttccccgctgtcataggcttccagatggaagttaatcagcacaagctctttatccgtatttttgagcggaatcctggtttccagcatgcagcgcttcagattgcaggtcttaaccggccatgaaaacgactccggaagagcgatgcgcgaggaatcgcttacatgcagaccagtcatagtgacaagcccgctcgtaacctttccgattggaggcagcgggtatggaacgtagtcaaccttaaaattgcatgcaaacattccgggcagccccagttcctgctcatagtaatcctgttcgtcaatatggtaagacctcttggaatcccggtccacttcctggagaaaataaatatccgcatcctgctctttcaaaatggatgcgattccgctcaggttgttttccactagctctttgctatccggctgcaccttactgcccccgtccataaagaaatcctcatctttactcagcccggcatacccggtattataggttagaactgtaaacatttccccagtccccaattcagcggttccgtctcccggttctatcgtctccacggcatccggccgatattcacggatcgtatagtaccccaggattgcagctgctacaataatgaatgccagcagaatgatgccaactgcttttaatgcttttttctttttcatacactctggtctccttacccccaaaaaggattttcttttgtctggtgtccttagctgcctgctgcagcagacacgatcgcgtccgcctcttcgcgggtcagatatttttcttcaaccatggaatccagcacctttttctggcgcagccgggcaagttccgggtttaccgtaggtgcataggcggagggggcatttggaatcccagccagcaaggtgcactcataatcattcatatcctgcagcgctttaccgaaatatcccatgctcgcatccgcaacgcagtaataaccgtctccaaaataaatgctgtttacatacaattccaatatctcgtctttactgaattttcgttccaatgcaattgccatgaagccctccgccactttcctgatcaggcttctctcctgggtgaaatacatatttttggcaagctgctgtgtgatcgtgctgccgccttcaatcagttgacgggcatggatgttattcttgatggcccggccaatcgcaatggcgtcaatccccggatgtttataaaaacgtttatcttctacggccacaaccgcgttcaaatagatatccggcagttctttcagcggtgtgtacgatggtgatgctttgatttcttctgctttctggtctatgctcatatactctaaagcatcttcgtattttacataacccttatatcccaaatatcctcccacacacagaagacacaggagaatcaatgccagcagccgtctgataaatttcatatttgtcctctctttcgtacgtttatctgtatctattgaaattatatcagaggaagataatattaacctaataatactcttaaaaatttcttaaattgttaagaatcttataaaatattaggatagcagcatggatcaggaagggcgatttcatgggattccctgtgttttgaactataaccaatataagattcttatgttctactagtattttattagtgccgttttttagggttttactagtgtcgttttactagtgcaattctgtctattcctcacagccccacgtccaccctcaattgtgttccggaaggattcaacctcaccgatcagataccacaggtgcggttgtttcttccgtggcttgcgtgaacgcctgacagcttcacaggccgtaggatcatgatatccttcatggtttctatttaatcccactcagcaacacctccagttcgtcaattttcttctgctgctcatccgtcctgattgcccccaaaatcgcattgcaggccagtatgatagtatttgccgtcttggtatctatttcgccattcaaggccatattcgctaccctggcaagcgtccgtttaatctctgttgttgttctcattctaagcctgacactcatgttgttcacccccaaaaagcctatcaagatcctctattgtttccgggctatatcttgccttatcgtcctgcaccggcggtctgtcccaccatttcatgagaatgtcaaaagtagcttcacatttcggatattgctctttgaaatccgggctttccaataagttctttacagccatttgccccacctcagtactcagatcagggcattccatgccgcggttatagtagtacgatactatgtcaaaataagcaggaacggcttttgaactgacctttataaaacattctctttgttccctgcccttcatgtcgtgcagcgctttcttatacattttatctaatttattcatgcaattttccttcaaaaataccccagacgcaagaagaaaacgcccagggtatccttatcaattattgattactgtctacgccgcaagcttgttagcctgataatagatagcttccttcttgttatccagtacgaacgcatcataaacaatgcgcccttccacaagttctccgctgattcctggtggatcactatgtactttgtaatcctcaagcttcgtaggggcaactgttgccaccgggtgagcaatcataaacccgaaattggcatccaccctgttagatggcaccttaatgaccgtaatcccatcaatcatggcaattacgcccctcagccgcatctcttcgctgatgtccgttaccatcataatgtcaggactcttcttcatcagcaaatacacatccggggtaatcagaagcacgcgtccagtctctggaacttccgcgttgtcaagcgcgttattccctttcaggatttcatcatagatattatcttttgtcagcgtgattgccgtaggctttgttcctgctccggcagtcatgactccgtagacatatttgtcaacctccggaataataacttctctctgctgtcttgcaagggccgacgctcccgtcaatacaccgcctgtttcgtctctgtccattttatcaactacgaatgtaaaggaacggtctttcttcaatgcaaactcttcaagcgtattgcctacgctgccgagtgccccgtatcttgaatcattgcttcctgatccggccctatcgtaatcattcatgctcacagtgtttactttatgtactttcactgtgtgcgctcctgtccatgaaaaatcctggtttgtcaggagtgactttttactctctgtgtaaaacatttcatccacatgtggaagaaactgtgtaactaaattaattgccatttatttctaccttagtgctttaggtgcaaaagcattttttatcgcccgttccttcatggcccctttagaacttgaatcattgattccaacccgtggggcaggcccagccaactgcctcttaaattcagctccaagggccctacggaaaacgtctgtcacctctgcatagcttttctcaaagtcttccttactactatagtccatcagtgtagccaatgaggaaggcattccatccgcaattagtgcatccattgcatccgctttcagctcccttttaagcacttccctttctcttgtttctaattcgcttacctgctgttcttccgtgaacagcttctgcatcctctgacgctcagcggcgatcttcttcgcaataattcggtcaacatccgcatctgtgtattttttctcaggctcactatgttgcccttcttgattgccctgcgcaccttcctgatcttctgcagcggaagcctctgcaccttccataccttctgtaccctgattcaataattcttcgcccatattggctcctttccgttttaagcccgccggctataattttcgcagtttataccgtgatgccgcacgcagttcaaaaccggagtaacaacacatcaaaagaggacgcaggaacggctttaagacatttctgtccataagctattcccacgccctcaggcttacactggtaggagaaaaaccagtgcggtacttcgatatattgttatacttattctatcacatatagggtgggtatgcaatcattttccctgattttccgctgtctgccaccagttttcagtaaccaattcagcagacaaacagccttgtttgatgtcaatatacgctcttttgaagcttccttttgctggctgcggtcttactctcttgaccggatgcagccgccttaatacctctgaaagctccttatcgtccgtataggatactttgatctttacgctcactctcttcctcctcttcatccagcagaatcagctctgctgtgtcctgatccactccgtagtttgccattatgtcatatagcctttgttctctctcctcattcattccacgtgcctccgctcagccttaacatcccgccgccgggttcaggtgttggcgcaccgtcccccggaaggcgaatacttttataaactatcctcaaccaccatgattactctttctatgaacggttttgcagtggccgttgtctctctcataacttcgtttttccactgctggaactcactctttgacagtttccgacattctacaatcagttcagcaaccatctgtataatttcttcccttaatttcctcataatttccttgtcctttccccggatcacatgctattatgtaagtgtcctttctgcatggctccggctatgctgccctgtagatattggcgtatctatggggctgttttcattgttacccttcataagttgtcacatcgccacagatgaagaacgtcccttcttttcctacgcactttccaagtttgctgtctattccttccagagcggttgctatacggtcaaggcgttcaagttccataatcttcaacgtcatgtttgagtatacgctgttcccgcagttctcattgaagtccttaattaatctttcatatccttcggtcattgttctactcctttcacagtcctattaatctgatttcgccactgggttcaatcattgttccgatatcccgcccaatcagatcggcgatctcctgtacaacactaaatgtatattctctgatgccattcttttctatgtatcggtctatcattcgccgctcctgtctggtgaatccggcgaactgtatttctgacaattgtaaattcattcttcacgctcctttttttgtagtttccatatgctctttctggatacattaaaatacactatgttatacgcttcatcacaatatgagcaatcagcataaaaaccacaccttgccatagcctgtttaaactcttcatgtgttgcttgcggtatatctctctttacatagcttaaaatctgcgccgaatcataaaagtcatttctaatagttttcgtacttttcagattccttttaatccaattacataatctattctgattacttataatatcattgatcaccatgcattttacacacctttcattgttccctatagaaggatctattacactggtctgtacgcgtgaaacccttgattttactgggttcgtccgtactaatcaatctgatcaagtatgtaagtacatgatcacgtacatgatctccgtactgccgtagttgttcactttgatcaagtacatagacatattgtacgcccggatagggcaatgagaaaagcagtatgaggtactgccccgtaagataacgcgggaaacaaccagcctaaccgaaaggcgaaagctgacacgggaacacagtacggctggaaagcggtaagtcacctaaaggcaatcgggtgcgactgaaccgcaatgttaatcggatataaggtataagttggatttactgaacgtgagcttccagtttctgttatgtgccgatagaggaaaattgcctgaaacctctggtacggaaaaggcaagttatggttgtgggcttgtcggttatcaatcattccgtacaacctgtaggggaacctatggtaacgaagcgaaagcgataccgagaatccgaatttaccaagtctcattgctaaccggggatgccctaaccaggagtgccgcacgaaaggaggaatgaaaaagcggctatggctttggagcctgaaaatcctgcatgggtacggagtgctcgtagtagtccgagaggggtaatgacccttacatggcgaaggggcacagttattgcgcactaaaattagaagttgattagggaggaaaacctcacatgaagccaacaacggaaattttagcaagaatcagtcaaaactcacttgcaaataaagaagaagtatttacaaaactgtatcgctatctgttgcgtcctgacatttactttgtggcatacaaaaacctgtatgccaacaacggtgcggcaacaaaaggagtaaacgaggatacggcggacggtttcagtgaagccaaaatagatagtattatcaaagcattggcagacgaaacctatcagcccatgccggtgaggcgaacctatatccagaagaagaataaccgcaaaaagctgcgtcccttaggtataccaacctttactgacaaattggtgcaggaagtgttgcggatgatactggaagcggtatatgaacctatctttctggatgtctcccacggttttaggccaaaaagaagttgtcatacggccttaaaacagttgagacgggagttcaacggtacgcgttggtttgttgaaggcgacatcaaaggttgctttgacaacatcaaccacgctgttcttgtaggcttgctgaacaataaaatcaaggacgctcggataaccaagctgatttacaaattcctgaaagcaggatatttagagaattggcagtaccataagacgtacagcggtacaccgcaaggcggtatcatttctccgctactcgccaacatctacctgcatgaattggacaagtttgtaatgaagttgaaatccgaatttgacacgcccggagtgggacaaatcacacctgaataccgagagctgcacaatgaaatcaaacggctatcccaccgcttgacgaaagtaacaggtgaggaaagggaaatggtgctggcagagtataagcccaaacgtcagaaactgatgaccattccctgcactgcgcagaccgacaaaaaactgaaatatgttcggtatgcggatgattttctaatagcagtcaagggaaaccgtgaggactgtcaatggattaagagcaaactggccgagtttatcggagatacactgaaaatggaactcagtgaagataaaacgctcataacccatagcagtaaatgtgcaaggttcttaggctatgatgtgcgtgtgcgcagaagcggaaaaataaagcggggtggccccggtcatgtaaaaatgcgtaccctcaatgggggtgtagaactgttggtgccacttaacgataaaatccgtcaattcgttttcactaaaggtgtggcgatacagaagaaagatggttccatgtttccagttcatcggaaatatctggttgggctcacagacttagaaatcgtttcagtatacaatgcggagttaagaggaatatgcaactattatggtatggcaagcaacttttgcaagctgcactatcttgcctaccttatggaatacagttgcttaaaaacccttgcttcaaagcataaaaccagcctatccaaaaccattgacaagtttaatgatggcacaggaaaatggggtataccctatgaaacgaagcagggaaacaaaaggcgttacttcgcaaattacgccgactgcaaaggcaagggccctgctacggattacatcagcaatgctgccgttgtctacggatacgcagtcaatacccttgaaaaccggctgaaagcaaaggtctgtgagttatgcggaacgacagagagcgaccattacgaggttcaccacattaacaaactcaaaaatctcaaaggcaaggaacggtgggaaatcgcaatgattgccaaacacagaaaaacgcttgtggtgtgcagggattgccaccgcagtattatccacaaaaagtgagttttgtctgaatgagcagcaacagagccgtatactccgagaggggtacgtacggttcccggagagggtggcgcaaacctatcacagcaatgtgacaaggcggtgcttccctactccactattttaaaggcttttacccgtacttatcacgtttagaagtgcggctatagtggctgatctgtttgtaagtcaagttcttcctgcttgggttctggttcatcgtcttcatgccctggaagaatccagatacttctgggcgggaactctttcgtttttctggtaataattccaagttcctctctggctctcctcaaagaaatatctgatattttattccctttagcaagattaaacagctcctttgccagcctacgcccttctggcatattattcataatgaactgcttcgctgcttctactgccggagcatctttcacccttttcttactcctgatcgccgtgtagtcatccattgacaggcagttctcgccgagataaacaatgccgcccttatccgggtctatttcaaacagaatcgtcttccctttcttatcaaggcttgacttctcatgtgacatgaatttcatatcctcttcacccggcacattccccagtgctatgtaacttctgcaagctcccataatatcggttgatccaagaactctcgttatagcatcgccttttccgttcttgttgaaatgacagataataaccactgcaacgtcatacttatctgcaagttctacgatatgccccatctgttcccgtgtcttatttggagcgttcatgtccacctcaccgccgatatacgattgaaatggatcgaatatcattaagtccggcctgacatccctcatgtattcctcaatttccgggctgtcaaaaagtaactggtttttgttatcattaaccgcgaaagcatttttcatatcggcaccgcatattctaagccgcttttttattgtatcgcctatcccgtcctccgaagtcagataaatcactttacccggtttgttactgaatgggacgatattaaaaaaacttctccctgttgaaacacaggccgccatatagcacaaaaggtatgttttcccggttcccggatatgcagcgcacagcgtgactttcccgcgcgggacatacggctgatatagccatctgatctcttcctcttcaatgtcattgatacataccagcgatatcttttcccgctgttttttggactgtctgaactcgccattatcgcataccgctgtataaggtttttctgttttccatcctctttttaataccgggaacactgtcttttcaagttcctgatcagtaagcggcgggacgcacttctttgcattttcgaccctgactgctacctttatggcttcatcgtcaagtccttttgctttcaggcttccaatcagccggatcatggtgtttgtccgctctccctccggtataacttctggttcctggaaagtctgattctcccaatcctctggcacagggcctttaaggaagtccataactctattgtctgcctgggcgatctcgcaatcccccggcccctgttcccattcatactgatgcccatttgggtgtatgctgggtggtgctactatatagccgccttctccacggatgtcaacgccatcataaagccctgctctgtttcggttggtagctccatctttgtatatgtagtgatatcctccgcgaccagtgatgcttgtccaggtttccggcagttctccgttttccttctgccagatagccaggctctcatatccattaatgcccttgtccttgtccacatccaagtcaatcaccaccaagccgcctgaaacgctccctgttgctatcccgatattataatcagggcatctatcccaccaggctccaatctgctgtttatttatagtagccgccttacatccgttctctgttgctggacgcttatcctttggtttcagcgggaatactgccagccctatatcggcatactttaaggcccattccttcattgtctctgccattattcacccgctgcctttcccgtttccatcctgtcataatcaattaccgtgtccggatcaattcccagcgccttgcagacgcgtccaaaccgctccagcttgaccatatagcccctacgcatccgatagactatattgacgcttacgcctgccttatcggctatttcctgcggtgtcaggcagctcttagccatcgcccctataataacctgtacttttgcacataccatcctgattcactcctttctgcctgatatcaggctgaatccttccaatcattccaaagcccacacccgcaccgtgtgttagttttcagtctcaatgatttcagttacgtctacgccgagagccttcgcaattttgccgacagtctcgggtcttaaatcgtctctcatcgccctgcacagagtcccttttgggatgccagcagcttcaagctccttctgacccatgcaagcccgtgccctggctatcatgtatttctgcttatcaattttcaaggttcgtcttcctcctttctaagagaactattattgattctcatttatcataacagaactatttttagttgtcaatatatttaatagaactatttttagttgccacagatcattatgtgtgctatcttatataatgtaagggaggtaatatatgaaaccatctaaattattgcgattaggcggagtattaagattttacagaggaaaaactggaaagactcaaagcgaattcgccgagctatgtaacattaatgttgtacaatacagaagatatgaaaacaatcaaagcattccgcgtcaagaacagcttgagaaaatattcagtacgcttaataaactaggaattgtaaatcagattggcgaacctgttacagtcgataatttcaaagattatgacttcaccgacacaccccaacccacaaggacaccagaagaacaggccatatggcttgagcgcatgaaaagagcatatgataagagtagtgccctcagttctattaatgatagtttgaacaaactgaacaatgacgggaagaaagaagccgctaaacgggtggatgaattaaccaagatccctgaatatcagaaagacaaagaatagagggcttactaattttttagtagccgaaatttcggcaccttatgccagtgcacgaagccgtacatttttgtacgccttatgccagtgtacaaagccgctaaaattttagcaccaccgtacatttttgtacacagggcagtatagcggaattttccgcgctatgcacattgacaataatatacttacccagggaaccgttggggcgttatgtcagccgccggacgaaagaaaggaggctggtgctgatggttacatatgatgaattattcacgtttgtaattatgctttgcgccgtcattactcttgttgtgacgcttttgaaacgtaaaaaatagcgcccctgctctggtaaagtaaggcgctatttcttataacacttattttcccggcggtcaggtgtacgctgaccaacggttctcttgttaagtatattatagtcaatatcaccgtttctgtcaatatatcttccagccattccaaagcccacacccgcaccgtggatgaatggaaggagaatatagatggcactgataacatgcccggaatgcaccgggaacatatctgacaaggcgttattctgcccgcattgcggctttccattgcaggatcaaccaattcctgcccggaagcccaaacgtgccggaaaacgccgtccaaacggcacaggcaccattgttcccataaagggcaagaaaaagaaccggtaccaggtacgggtcaatacccggatcgatgatcggggctatccgatctatgacgttctgggaaacttcccggatcagatatcggcagacatcgccctggctgaatacaataaggacccttacgacccagcgaaccgaatgaagactttcaaagaaacattcgaagactggtacaagtggaagttcaagaagcccgtagacgcaaagggcaaaaagaccagctcccagtattgcagcgtggcagcattcaaacactgccaagacctgcatgaccgcgtaatgtccaaattacaggccacagagctacaggagattctggacagagaggacttgtctcattccacgctggagcatataaaaaacctgttcaatcaaatgtataagtacgcgttgcaattcggaatcgtggccaagaacctctcagaatttgttcagataggcaaagaggacgatacagagccaggtgtaccatttaccgaggatgaacttgcccttctctggaagaataaggatcggccttttgtcgataccatccttatatactgttactccggctggcggcttaatgaactggcccggatgccgctgaaagatatcgacctggttaaccggacattcaccgggggactaaaaaacaaatatagccgtaaccgtacagtaccaatacattccaaaattatcgacatggtggaatccaggtatgaccccaggttcaaaagtctgatataccacaacggaattaaagatatatcagaagcagactacagggagcagttcaatcaagcgcttctggattgcgggatcactgaacctcacaccccgcacgactgccggcatacctgcaataccctgctggataacgcggaagtgaaccgagtagcccggtacaaaattatggggcacgcgggaaaggatatcaatgaaaaagtatacgcccacaaggatatcaaccagcttcgaaaggccattgagaaaatttaatttaagccatgaatgcagccttacccgctgtactcatggctcttctattagaattttattagtgctgtttattcccaggaatgcccattttacgcgattcccaacactattgctcttatatttttcttaaaatctaacaccccttattccgcggcttgtcctctatatggttaaggaatcttttgtaacactactatgcatactaattactttctagcaccgcaagtaattcttcggcgctataaaaaacatctctatcatatccctctgttgctttcgttttatcatatatttcatttagagaactgatataatcttcctctgccatcgctatgccattccaaaagtatttgtaaacaagtcttccgttattgtcatactctttattctgataatcctcaacgccatagtttccctcagcaatcagtgtcagttgtccgtctatcatactatatactctatctttataagaatccatcagcccctctgaattgcaaagcatgttttccttttcaatatatgaaaaaccaagcctgtaaagctctgtttcataggtttgtctgttcgcataggtaacaatactggaacctgctgcttcgcagctgccgataactgctaattcaggtatatcatcgctatctatataaataagacgatatcccgttacaccgttaggatcatgtgtagtctgcacataatctgcgaatgcccgtttccagtatgagtccgtttgtggttccactggttcttctttctgtacactttccgcgggggctgtcccctgctggatagccgacagaatattttgaatcgttttgtctggaacttctgcattcacctttttcgtcaaactattctccagaaaaaaacggccttcagagcttccgtaatatattctggcctcagaataaacagagtcttctctgttaccgggcaaataactgcatataatgataatatcgtcatagctgtccagattataatctgggaaagacacggcttctaccttattaaaagtttcattttttctatcataggaaccattcatacctggaagcacagcgacaacctgctgatctgccagcaatttaaaaaccgcatcattatatatactttgcgacgtatccggagcgtaagagacgaatctaatctttcccaatggtttcaactccgtgtcaaaagtctgatcctgaattagcctatctgtattattataccaccaatttcaaaaccaataaagtgtatttattaagaacggaggaggactgacgcatacagcaaccatgccgctactgtccatattgatccataaaccttgctgaacgacatcggtgcgaataaagtaacgtattgtccgcatataactgacggaaccacagagccgtctgtgtcatacccatatctccggaatataataatataccaatatatgattgcagaagacagcggcagaacacggtaaggccagccgctctgacctcaaaacctttaggagaaataaaatggttactaaaaatatgatgcaaaaattgacggaacaggaaatgatcggtaaagatgtgctggtacaattgttcgaagaaacctttaatgcagggcgctgtgctgtgaaaatgctgcgggatacccccttatatcagctaaaggcaatcttcctgctgttcttggttatgatacagaagaagccctgcttcacgaaaacgaattttttgccggtctgatctttgaggaagaccgtacttccgtattaaaggtattaaaaaaaacggctgctgaaaaaaacagcttttcaatcgaatttagatgccgtggcagggacggtatgccagtggcactctgcggcgccgttatttttctgaaaaacaccgggcatatactattatcttttatcaaagctgcggaaaccatctgggatcggatattccgtctgctcccatgcggtatctgccgtgtagcggcagatgatgtttttacgatactgcaggcaaacgaaatatattatgacatatacggatatacatccagggaagcctcctccgtggggttcacaaatgaaaaattcattattcatccggacgatttcgagtacgtacaacataaggttcagtgttgtcttgagctcatggacagctctacctttgagatggaacatagagtcgtcatgcgggatcagagcctcggctgggtactggtgaaaggttatattgacagaacagccggtgattgctgcctcaactgtgtgttattggatatatcggatcgtaaaaaagcggaggaagacctgcggatcagcgaggagcagaaccggatcgcatttctttcgacagataattatatggatatctatgatgtaaaaactcatgttcttgaacatccgtatgaggacgccagtgaaagcaggagacctaagagaatagaaaatgttccctacagcatagttgccgcagggcaggtagagggcgacagcataagagattacattcagttatttgattcaatagtgaaggggagtcccgagggaaaatgtacagttcagatgaatcatagggatggagaccatttcggctggtatgagattaaataccggctgatctttgataagtcaggcaggccggaacgtgcagtcttatcctacagagatataacatctcagagggaaaaggcgcttgcctatgaaaagtggagccgcttttttgatcagcagaaaactaacagccttggctactacgagtataatctgacgaaaaatctatatgccggaagtgaagacagtcttttgaattcacttcccccatatattcaaagctttacggaggccgtcagttattattcagcacactgtgtgtatgaggaagataaagaaaaatatatggaattttacagtcgtgacaggcttctgtccgcttattactccggtacgaagacagattatatcgaataccgccgcaggcgggaagaaggtgggcttttttgggcggcaggaaccattcagctgatctctgacccttatacagaggatgtccgtgcatttattcttgtgcaggacatcgaccagaagatccaaaggcaaatcaacatgaaaaaacagatagagaatgattccctcactgcactgttgaacaggggaaccgccataaggaaaatcgcctcagaactggcggataaggaatccggtcggcgttctctgctggccatgttagatgtggatcattttaaggaaatcaatgatactcacgggcatcagtttggcgaccgggtattgggcgatatcggaaaagtgctggcctccatggcgggagaatgtgatgtgtttggcaggatgggcggggatgaattcatcttttttttagcagatgtacctactgctgaattagcagaaaaatatctgttgaaaatcagcacatcacttaatatatcataccagactcctaaagcgacggtctctgttagtatcggcgcagtctatccctgcggcggccttatgtttgaagaattatattccagggcagacgcagcgctatacgaggcaaaaaaggacgggcggaaccgatttgcaatcagatagtaacttcacatgcaggacgcacactgcggcagttctaacgaacaccgcagtgccctaagtaacgactgctaaaacaaactccagaggaattttatatatcataaataaccgctttttacttatgatatggctccccctggataatacggtaactgcgataaacctgttccagcagtatcaaccgcattagctgatgcggaaaggtcattttagaaaagctcagggcaaaatcagatcgcgccaacacagaagagcttaaaccgatagaacctccaatcacgaaaatgatatggctggtaccggtgacgcccagtttttcgatcttattggccatctcttctgaagtgatctgatttccctggatctcaagagtcatgacaaaggcatcctctttgagatgctttagaagccgttccccttccttctcacggatactttcttcgaccgcctcgcctgcctgatccggcgttttttcatcggcaacctctatgatattcaatttacagtatttactcagacgcttactgtattcttcgatcccatctttcagatatttttctttgattttacctaccgataaaacagtgactttcatatcttttattccttcaattttatttgtatcgtcatggggctaatctgctctcagagcgcagataccctgtcaggctttcacagcccatctcatttttgcagaccgggccctgctgtttctggcgcattcttctgccgaaggccgaattacatcctttgaatagctgctgtatatcccctcttgaaacaactgcttaaatgatttctttaccagcctgtcttcgcctgaatgaaacgtcaatatggcgactcttccgtctggtgcaaggatattgggaagtttttctaaaaactggtagagcacttcaaactcgttattaacatcaatgcgcagtgcctggaaggttctctggcaggattttttaacggcctcctttttctcagtggcagggagaaaattcagtgctttgtcaattacgttccgcagctgcccggtcgtttcgattttatttcccgattttagttcagctgtaaccgctctggaaatctctcctgcatagggttcgtccgaattctcaatcaacatgccctcaagttcttccggttctatggttcgcagcctctgcgccgctgtgatccccttttcgggattcattcttaaatccagaggcccgtttgttttgtacgagaagcctctgtctggattgtcaatctgcatagaagatacgccaagatcagccagcacaaaatcaaactgtccggcctccttagctatctggtctatgtccgcaaaatttagaagctccacagtcagaatctctgatccgtatcccatacctgcaaggcgttcttttgttttcactgattcgataggatccacatccaaggcataaatatgcccctcatgttccaggcatttcaacatttccagtgtatgtccgccatagcccaatgtggcatccagtcccttctggccaggctggatctgtagaaaatcaaggatctcatttacgcagatcgaaatatgcattccggcgggcgtacttcctttctgtatgaccttctcaacagtagacgcatacttttccgggtggagttctttgtatttttctttataattcctagggtgcgtccccttatatctgggacgccttttgtgttgctgttcctggttttccattctctttaccctttcatcaaaagtggttttcagagaaatttcagtctatataaaaaccacttactaaaaaactgtgtatctatttaaaaacatggacaaatatgttcttattatatatcaggaaagatatgacggcaatcttttttaataggaaactcccatgatgctcggactgcctggaaaaaacatattttctttacttcatacatagattgttctgtcagtaccttcaagtaaaggagtaaatattatatgaataactgtgataatgggagaaataacgaagccattaaaccggatacctgccagaaaaaagagctttttgcagccgacgccccctatcctccggtctgtgtggatggtgtaaaccgcctctatggaagaatgatgctggataacgtaggcggacagaattcagagatgaccgctgtcagcctgtatatttacaacaacctgctgttggtggaggatgaacgcctatcctatgtctttcacaaaatcagtattgtggagatgcaccaccttgagatattcggacaactggcaagaatgatgggagagaatcccagactctggacttacagagggaaccagatgttttattggtcacccgggtttaataattaccctatggatatcaagcctctgcttatcaacgcagtcaaccatgaacgccaggccgttcagaaataccgctctcagtgtgctaagatccaggatgagaatattgtaagatgcctggagaggatcatcatggatgaggaactccacattcagatttatgagtccctgtacgacgaatactgcggatagccggttaagctgcttttatgcaaaaagagactgctttgtgcagtctcttttaatacttacgatgtactagtactacttttatttatttcacagggttagcggccagatacgcttctgtcaattgcaccgcatcttcaatgcattgatcacagctgcaaataggcctgtcggagccgatcccttttaattcacggcagatgatagactggttcttctcacggaattttgctgcgcactcctttactttcttataggtgtccgcttttgtagatttccctttttcaaggcttcctacactgttctgtagccccagtatcatagtcatgccggacacggcaccgcacacttccatcatacccatgccaaatccgaatccttctgaaatccgaaacatctcctcttccgatatgccgaaatcccggcagaatgcgcaggctacggcctgacagcaattataaccttttttatgatattccagtgcggtttcttttctggtcatagcagttcctcctgtgtaaaatcagcttctttatttgttcagatattcatcaatgccttttgcacctgcttttccagcgcccattgcaaggatcactgtggcagcgcccgttacagcatctccgcctgcataaaccccctctttggatgtctgtccgttttcttcttccgctacgatacattttcttctgttcacttcaaggccttttgttgtagaagaaatcaacggattcggagaggtaccgagtgacataacgaccgtatccagttcgatttcatactcggagcctggaatctctaccgggcgtcttcttccggatgcatccggctcgcccagctccattttgatcaccttcattccctttacgtatccgttatcatccacgaggatttcctttggattagtaagaaggtcaaaaataacaccctcttcttttgcatggtgaacctcttctactctggccggaagctctgcttcgcttcgtctgtaaacaatatgtacctcggcaccaagccttaatgcggttcttgccgcatccatggcaacattaccgccgccgactacagccactttttttcctgcaacaatcggagtatcgtaattatcatcaaatgccttcatcaggttgcttcttgtcagatattcattggctgagaagaccccgtttgcattctctcccggaattcccatgaacattggaagaccagcgcctgagccgataaatacggcttcaaagccttcttcttccacgagctggtctatggttgttgatttaccgattacgacattaggctcgaatttgacgcctaactctttaactttttcgatctctttcgcaactaccttttgcttgggaagacggaattcaggaattccatatacaagtacgccgccgagttcatgcagcgcttcaaaaacagttacgtcatatcccatctttgccaagtctccggcgcaggtaagccctgaaggtccagaaccgatgactgccactttatgtccgttcttcgtctcgggacactccggtttgatgtcatgttccagcgcataatccgctacaaatctctcaagtttaccgatcgaaacaggctctcccttgattccgcggatacatttcccttcgcattgtgattcctgaggacatacacgtccgcagatagccggaagtgcggatgcttttccgattactttataggcttcttctatattgccttcttttacttctttaataaaacctggaatatcgattgctaccgggcagccgtcgatacatttggccactttacagccaaggcatctgtttgcctcctccatagcctcttcccggttatatccaaggcagacttcttcaaaattcgttgctcgtactttcgggtcctgctctctgacaggcactttctttaatacatcagccattagttgtcacctccgcagtttccgcatccaccatgatgagtgtctccttcttgcactttcagcatcgcacggccttcttctgtcttatacatctggcttctcttcattgcctggtcgaagtctacaagatgtccgtcgaattccgggccgtcaacgcaggcaaacttgatctcatcgcctacctgaaggcggcatgcgccgcacattcctgttccgtctaccataatcgggttcatgctgacaattgtaggcaaatccagtttcttagtaagcagacatacgaacttcatcatgatcatcggtccgattgccacgcatacatcgtactgttttccctcgttctgtaccaggtcctcgataacggccgtaaccatgccggaacgtccataagaaccgtcgtccgttgtaacataaagattgcctgctacagatgcaagctctttttcaagaatcagcatgtccttcgtcttggaacctacgataacatcggcttcaatgccgcgctcatgcagccactttacctgtgggtaaaccggcgccgcccccacacctccggctacaaataatatctttttattcttcagtgcttcgatatcttcatgaataaactcggacgggcatccgagcggaccgacaaaatcccggaaactgtctccttcttttaagtacgccatcttcgttgtggacgcacccacttcctggaatacaattgtaatcgttcccgccgctctgtcatagtcgcagattgtaagcggaattctctcacccttatcatccatcttaacaatcacaaactgtcctggctggcagtggctggcaacacgcggtgcatgtacatccataagataaatcttatcagccagtttttctgcttttaatatcttgtacatcttattcctccttgtaaaaaatcaccctttccttataatacgctataaataaaggattggcaagtgttctttcaaaaaacagagcatgttctgtttttcctttcataaaaatggggcagacacattctcgtgcctgcctccatccatatgtaccagggaaccattcaattaaaaatcaacttctgttccatagtaaatgcagttaaataatctttccatctctgcaggagtaatgcttctcggattagaacctgtgcaggcatcacctacggccagttcggaaatatgtgcaattttttctttgaattcctcttctttaataccgaattctttcagggtctttggaatgttcagctgaacattgaagtcgtcaatcttttcacaaaggctgttgatcagagccttttcggaagtcccctgaagtcctgtcctgcgcgcgatttcggcataacgttttgcggcaacaggatcttttgcattgtacttaattacatatggaaggtacattgcatttgcgcatccgtgtgtaatatgccctgttgaaaaagctgcacctgttttatgagccattgagtgtacgataccaagcaatgcatttgaaaatgccattcctgccaggcactgtgccgtatgcatctgctctctggcatccatgttgcctctgtaggaagccggcaggtaatcaaataccatctcaattgcctgaattgccagtggatctgtaaatgcacagtttaaagtagaaacatatgcttcgatcgcatgggtaagtgcatccatccctgtatatgcaacctgttttgcgggaagtccctctaccagttcggaatctacgattgcaacatccggtgtgatattgaagtcagccagcggatattttacgcctgtctgataatttgtgataacggagaacgccgttacttccgttgcggttcctgatgtagacgggattgctgcaaactttgccttctgtcttaattcagggaagttaaacggaatacataagtcttcgaaagtcacctcagggtattcatagaaagcccacattgccttggctgcatctatcggggagccaccgcccatcgcaacaatccagtccggctcaaacgcacgcatcgcctcggcgcccttcataaccgtttcaacagacggatccggctcaaccccttcaaaaagctctacttccatgcctgcatctttcaggtatccgactgctctgtcaaggaagccctgacgtttcatggaaccgcctcccacgacgagaattgcctttttccctttcaggtttttcagttcttccagacagccttttccgtgataaatgtctcttggtaatgtgaatctgctcattttattgcatctcctttataagtacgttatttttttaacatgctaattataacactgttaaagttttaacgcaacccaaatacaggtaaaatcatgttaaaaattgcacaaaaatatcgctgcaattatgtcaaaaatatacacaattgcagcagcgttattctttacttattcaggcagttccaatacataatttctctttgtaatctgtgttgttttgccgcttttgctgacaagaaccgcacagaacatcgtctgcccttccggcatatcaatagggccttcatatttggcggaagcggcgctgggatccgttccgtccattgtataatatgcagtatacccctccggcacattgattgttatctgtgttgccgtatcatactggcctgtggacggggttactgcgggtgcatcttctaccggaatgtccacgttgtatactcttgaagctgtaaggctcggaatctttttcttattgacggagattgcctttatcgtagtcgtcccctcttccaggagaatcggatcctgatatttcgtgctggaggtatccggttcggaaccatccgtagtataatagatagcttcacctgcagagcttaaggatacttcctgtacctccggataggtaccctcttccaggctgaattccggctcttcggacacgtaggactttacgccgagaagaacgttgtcatcctcgcagccatccagcagttccgatatttttagcagctgcttagtctccacgtaaaagtctatggctgcttgatacagttccacattggagggctgggcgcttatggcagtcataaagaccgcttccgccccttccaggtcgtcctgctggctgtataccttagaaaggccagtataggcctctgctctcttatcgttttttgagatcgccttattaaaatagttttccgcctgcgtataatcattggtaacaagtgcctgatttcctttgcggatttgtccggtataggagttctgataaaaaacaaatccaagcacgcccgccagaatcagcaggacaagcacgatgatgagcgctctctgccgcctttttttcgcaagtctttttttgcgggcaatctgctggcgccgtctttcttcagcctcatttctttcctgccgcatggagcctgtactctggcgcatggatccggttgccattcttccagtctgccgcatagaacctgtatttctgcctgtctggcgcatgggaccggtagaggaccggctgccctgacgcacggaacctgtggaagtgcggcccgtctgatacctggaatcggctcctggctgacgcgaaggacccgatgctgctctgctgggctgccgcccctgtctcgctgccgcatttctccgggcgcgtatctcatccagttctccctggttcagtactcttgtcgaattactgtactctcttgttccgtcacggcggtatcttcggatatcgtctgtcctaatctgtcttgtggcgtcttcgatagaacccttcacttcctgagcgaggacatcttccagaggattataatctggtacaatctgaacttccatatggcattccgggcagtaaagcatgtcgtccggaatcatggcaccacaatgtgtacatctcatcttatttcctcctagctgcgcgcagtttccacacagttgttcatcagcatggcaattgtcataggacctaccccgcccggcacgggcgtaattgcagacactttatcagccacatccgtaaaatccacatctccacaaagtttgttattctcatcgcggtgcatccccacatcaatgacgactgcaccctcttttacatattctgaattaataaactgctttttcccgattgcaacgatcagtatatccgcacgccgggcaacttctttcagatttttcgtgcgggaatgcgttacggttaccgtcccgttttccctaagaagcagcgccgccatgggctttcctacaatattgcttcttccgatcacaacacattcttttccttctatcccgataccggagcgcttcagaagctggataatgccggctggcgtacaggataaaaatcctttttccccgatccagaggcgtcccacactttgcggatggaagccgtctacatccttatccggtgagattgtccggataaccagatcttcatttatgtgggaaggcagaggcagctgcaccagaattccattgacaccgctgtccgcattcaatgtctctacgagagatacaagttccgcctccgtcgtagactcaggcagttcaaacgcccgggactctatcccgatatacgcgcatgcctttttcttattattgacatacacagaggaggctgggtcatcccccacctgtacgaccgccaggcagatattgccccccatttcctttattttctgtacttcttcctttaattcgtcctttatctgagctgaaatcagctttccgtcaattatctgtgccattccatcctcctttagaagagcccggtaatcttaccatcttcagtaacatctatatgatttgcagcggggactttaggaagccccggcatcgtcataactgcgcccgtcagcgctacaacaaatcctgcaccggcactgacatatacctcccggatgtggatatcgaagtcctccggccgcccgagttttttcgcgtcgtcagacaacgaatactgatttttggccatgcagacggggaaggttccaaagcccatcgcctcgatctttgccagctgcttctcggccgcaggttcgtagactacaccgcgcgctccatatatttcttttgctatggtctctattttttccttcaatgacagtttgtccggatatagcggatggtaatggctttccttattctcaagggtcgcaagtaccttttccgccagcatgataccgccggcgccgcccttttcccacacttcggaaagtgcaaattcacagccgcgctcctcacagaatgtttggatgtattcattttccgccgctgtatctgtcacaaaagaattcagtgttacaataacaggtatgtcatatttctggatattctctatatgtttttccagattgacgatcccttttgcaagtgcttccaggttctcttcgcccaaatcgctctttgcaactcccccattatacttcaaagcgcgcaccgttgcaactaaaactactgcatctggttttagtcctgccttgcggcatttgatatccaggaacttttctgcgcccagatccgcaccgaatcctgcctcggtaattgtaatatcgctgatcttaagcgccgtcttggtggcacggacactgttgcagccatgggcaatgttcgcgaacggcccgccgtgtatcagcgccggtgtatgttccagcgtctgaatgatattcggtttgaccgcatcctttaaaagagcggtcatcgctcccgtggcctgcagatcgtctgccgtaaccggatctccatcaaaattgtaggccacgataattctgccgagtcgctttctcaaatccgccagatcatctgccagacacagaatagccatgatctctgaggctacggttataacaaaatggtcttcccttaccattccgtccattttactgcccagccccacgaccgtattgcgcagtactctgtcgttcatatccagacagcgtttccagacaatctgacggggatcgattcccagcgcgtttccctgctggatatgattgtccagcattgcagctaacagattgtttgcagaggtgattgcatggaaatcacccgtaaaatgaaggttcagatcttccatcggaaccacctgggcatatccgcctccggcggcgccgcctttgattccgaagcaggggccgagagacggctcccgcagggctatcaacgcttttttattcagcctggccatcgcctggccgagacctactgtggtggtggttttcccttcccccgccggggtcggattgattgccgttacaagaaccaattttccgtcctcacggtccttgaccttatcccacagatcctcggaaagttttgctttgtatttcccgtagaattcaagatcatcttcttcaattccaatgctggccgccacatctcttatatgcagcatctctgcatcctgcgcaatctgaatatctgttttcatttgattccctcctggattatatattatcttttatatactgttcaaattcttcttctgacatcaggatcttcctgggcttagtcccttcttcttccccgacaacacctgcctcagctagctgatccatgatgcgcgccgctctgttaaaaccaattttgaacatacgctgcagcatcccgatagacgccttttccttatctatgatcagctttcctgcctccacgaaatatgtatccctgtcgctgccgccctccgcggccccgggcatcataccgccggctgcaggcgctcccgcattagcgttcacatgctcttccacttcttcactataagaagcgttgccattgtgttcaatcagataatcaacgactttctgcacctccttgtcagaaacaaacgacccctgtactctgacaggcttcggaaaacctgtcgggtaaaataacatatcaccttttccaagaagcttttccgccccgttcatatcaataatcgttcgggagtcaacccctgatgatacagaaaaagcgattctggatggcatattcgccttaatcaggccggtaattacattgacagagggccgctgggtcgccaggatcaaatgcagtccggccgctctagccagctgtgccagacggcagatggctccctctacttctccgggcgctaccatcatcaaatctgccagctcgtccacaataatcacgatctgcggcatcttcctaggcgcgtctccgttcgtttctaaatggccgatcttatcgttaaatcctttcagatccctaacattgtattccgcaaaaagcttatagcgcttttccatctcagcgacggcccagttcagtgccccggctgctttcttaggatccgtgaccacggggatcaatagatgcggaattccgttatatacactgagttccaccactttcggatctaccataatcagcttcacgtcttccgggtctgccttataaatgatactcataattaatgtgttgatgcatacagatttaccggatccagtggctccggcaacaaggagatgcggcatctttgcaatatccgcaaccaccactttcccggaaatgtccttgcccactgcaaatgagataccggacttcttgttcttaaattcactggattccagcaggtctctcagcataactgccgtattttcattgttgggcacttcgatgccgacggcagcctttccaggaatgggagcctcaattctgagatcggttacagccaggtttagtttaatatcgtcggccaggcccacgattttgctgactttaactccctgctccggttgaatctcataacgggtgacagagggaccgcagcttgcattggtcacatgtacctgtacgccaaaattctgaagcgtctgctccagcttgagtgcagtggcccgcaggtgggcgtctgaatccccgctcgttttcttcccccggttcagcagggaaagcggcggaatccggtagactgccacaggctgttcttcctgcgccttgatggtctcttctacatgtactgcctcggcagccaccatctgggcactctcctgtgtcttacgctttttggccggttctggtgtcttaaccggtgtatccggtacgatctcttcaacagattccggctccggacggttaatgaccagctcctcaaacggagatggcacaggtgcttctccggcccccgtgtcctccggtgctaactcctgcagatcaggagtctttctgtgaattgttttgtctgataaggttgtggcaaaagaaactccggatactttatgatcctgccttttttgcttttcagtctctcgttgctgcttctgctctccccgcctccgggcagcagccgctttttttgttctggcgtcttcatacgcctttttactgtggcgccccagcggcgcaagaagcgatttctccgtgatcaggatcacacagattaccgcaaatatgatgatcaccacataggcgcccacgacgccgatcagcggacacaacagctttacaatacagccgcctattagaccgccggcattcttatgctggctggcaagcttataataggtcaataatcccgcctcagaatcgtaaggattcatgaccaattctaaaaatgcggtcagcaaaagcagcagcagaacaatggctcccacttttatgtacgcgtgtgcgttgcctttatttgatatggaaaaggcaaccacaccgaacaggataaatggcaatagatatgccattaatccgaataatccgaacattaccgacgaaactgcctcccctgcaattccccccaggccaaaattactaatcacaagcaggatacaaaccgccaatacggcaagtatcaaaatctcttctttgagggctgtattttcctgctttttcgtcctccggcctgttgtttttcttttctttgtcgactttgcagccattatacttcccccttggtatttacacatactgtatttagtataccattatttgaaaagcatgtcattattaaatttttctcactcaaaaatatcagggattaaattataaacccggcagatccaaacctgtttcttctctgttcctgtcttcaatcatggaatgaagtttggaaagtgcctggctgatgccccctacctcgtcgatcagcccttctttcactgcgtcttctccttccagcaaggttcccacatcttttaccagctgtgtggaatccagcattaatttttccaggcgttcctgggtaatattggaatgggatgcaatgaactttgtgatccggtcctgtgtcttttccatgttgcggtaactctggatcactccaatgaacatgccggtagatcttaccgggtgtacaatcatcgtaccactgggtacaataaaggaatagtctgcggaaacggcaagcggtcctcctatcgagtggcttccacccaaaacaagtgacacggtgggtttactgagcgaagctatcatctccgcgatggcaagtcccgcctccacatcgcctcccagtgtattcagaagaatcaggatgccttcgatctcatcattgtcctctgcttctgccaggcgcggaatcagatgctcatatttagtggcttttgtattaccggagactgcctcatgcccttcaatctcaccgataatcgtcatcagctggatattatgcctgccgctctccttgccaagcctgagggtaccggtctctttaatctcttcgttctcatcagcctgagtttttcgaatctgctcttctttattattatccatttttttcctgcctttccttctcgtaacaatgcttcatttttagatagtatctgaaagaaaaacaggaattatacattgatttgcaacttgctgcaaacccgccccgcaggggcatgcattgatttgcaaccaggcaaatcaaaaatggtatggatgattgtatacatccataccattcagattattgcaatgcctgctcaatatccgcaataatatcctctacattttcaatcccaacactgaatctgatcaggtccggctgaacacctgcctccagcagttcctgttcattcatctggcggtgcgtgtggcttgcaggatgaagcacacaactgcgcgcatccgcaacatgagtcacgatcgccaccattttcagtttatccatcatctcaactgccgcgctgcgtccgcctttcaggccaaaagtcagtacgccgcaggtgccgcccggcatatacttctgagccaggtcataatacttatccccaggaagagaaggacaggacacccaggccaccttctcatgatcctgcagatactttgcaatggtaagtgcgttttcacaatggcggggcatacgcagatgcagcgtctccagcccgatatttaataaaaatgcattttgaggcgcctggatagatcccagatctctcatcagctgcgcggtggctttctgaatataggcaagcttgccaaatttttgtgtatagacaatcccatggtaggtctcatcgggtgtcgtcagtcccggaaacttcccggactgcgcttcccagtcaaaattaccgctatccacaatggctccgcccacacaggttgcgtggccgtccatatacttggtcgtggagtgagtcacaatgtcagccccccactcaaacggacggcagttaattggagttgcaaatgtattgtctacaataaacggtacgccatgtgcatgcgccgcttttgcaaatttgtcaaaatcaaggactacaagcgccgggtttgcaatggtctccccgaagacagcctttgtgttgtccttaaaagcagcctcaagctcttccggcgtgcagtcaggatctacaaaatcagcttctactcccatttttctgatggtatgcgcaaacagattatatgtaccgccataaagtgcagaagcacatacgatatggtctcctgcctctgcaatgttcatgaccgcataaaaattagctgcctggccggaggaggtaagcatgccggcaacaccgccctctaaatcacagatcttagcggcaaccgcatcattggtcgggttctgcagccttgtataaaagtatccggcttcttccaggtcgaacaggcgccccatctgctcactgcttgtgtatttgaaagtagtgctctggcagatcggcaggactctcggctctccgtttgccggttcataaccggattgtatgcattttgtctctatcttatagctgctcataatttccttcctcctaagaatatagatatttcctttccagcttacgtaccatgtcgctgtagagcatctggcattccttctttttgccctcctcgatcagccggacgcagggacttagataatcctgccagattcccgcatatatactagccgaatcttcctgccggtcgatgcgttttacaatcgttggtgcgatattataatattcatttactgtttccataccttctttggactccagcagatactggtcacggtaattccgaagcagcgtcagttcataacagtcgtccggtttatccaggcttctgcagactgctgttgtgatatagcagagtccttttttgaagcctccctggatctgttcacgtgtggaatgcccgattttattatccggcatcctttcattatataactcaatcatcttttcggtaaactcttttgtcttcacgctgctgatctcccccagaagcgggacaaaaaaagataccatattcatattaaagtcaagacaggccagatccctcttcctttttgaaggcaccgccgccagctgctccgccgcataatccgggatgacagaggcagtctttgccagcgcctcatctgacacctcgaaggcttctctgatacgccccaggagcgcgccgtgcctgttcagtaatatgtccatatcagatgcataagtttttttatgaaacttctttgcatattcggcagtttcctgaaataaagaaatcatatctgcctgcagattttcctgattcatattatctcctctttttgtaaggtattggcataccgctgattattcgtcccagttatgatatacgtcctgcacatcatcatcttcatccagcagatccagtgtcttctgaatattcttaatgtcatcctcagaagtcagttccacataggtctgcggaatcatcgtaacctcggcatctgccatactgatgccctcttcctccagcttcaggcgtactgcgctgaattcttccggcgctgtgagaatctcaaaactgtcatcgctctcggtaaaatcttccgcgcctgcgtccagtgccagcatcatcagctcatcggcatccatgctgcactcttccttatcaaccagtatctgccccttctcatcgaacataaaagagacacagcctggggttcccacattaccgcttccctttgtaaatgcgttctttacattggaagcagtccggttcttgttgtctgtcagggcctttacgataattgctgtcccgttgggcccatatccttcatatgtaatatgctcataattgtcgcccgcaccctcgccggccgcttttttaatattccgttctatggtgtcattcggcatattattggcctttgccttagcgattacatcgcgcagacggctgttgttattcgggtccggaccgccgccctcttttactgcaacggcaagctcacgtccaagtttcgtaaaaaccttgccctttgcagcatcatttttttctttcttatgtttaatattcgcaaatttagaatgtcctgacatctctaatctcctcttttaaattttctttacgtattctatccgcagaacttgccatacaattttaccactcttttttgtatatttcaattctttcttaacagattcatctctgggttatgtaggaagttccagactgatccggatcgcatcgttcacccgcttcatcattccactgtctacatggcagacaaattctttcagacgctgcttgtcgatcgtccggatctgctccagcaggatcacggaattctttacaatatggtatttctctgcactgatttcaatatgggtaggaagttttgctttattcatcctggatgtgatagccgcacagattaccgtagggctgtgcttgttgcccacgtcattttgtataatcagtacaggacggataccgccctgttccgagcccacgacaggactcaaatctgcataatatatatcgcctcttttaattaccaaatcacttcacactccgattctaatactttgatacttgagtattcccgcttttttcggatgtatgcaagtgcacgaaaactttggacaatctttatgatgtactagaaatattctacttgttttacaacttccccgttcctggtataaacccttgggatccttctgcccagacagcagacgaactcatagttaaaacgtccgcagagaccgcttagttcctccacagagatgtgttcctccccatcggagccgaccagaacagcctggtccatgaacgtcacacccgggatatctgttacatcaaccataaactggtccatacagacccttccaagtatcctggcccgcctgccgcggatcagcacgtcagctttattcgaaagccctctggcgtatccgtcaccgtacccgacaggaattgtagctactttcatcttcttaggtgcaatgaaagtgccgccgtagctgatggaagcccccgcttctacttccttcacaaaagtaacgtggctgatcagctcaagcgctggcttgaggctcacagcttcccgcgagacctcccctgacgggtacattccgtatgtggaaatacccgcgcggaccagattatgtttcatgtccgggaagtcgataatcccggcgctgttgtcacaatgataatatgtaatggaagttccttccgcctccagggccttcttcatccattcaaacttttcgtgctgcttatgtgtgtagctcttgtcggtctcatcggctttggcaaaatgcgtatacattccctcgatccctatattaggcagcctgccgatctcccggatggcctttacactctccgggccgggcaagaatccaagccttcccatccctgtatcaactttaatatgtatatgtgctgttctgccgagctttgccgcggcttttgacatgccttccgccatctccttcatataaacagtagcacggatatccttaagaatcatctcctcatactgctccgggaaaatacagccgagtacgagaattggttttttaatcccttccttccggagagctgcagcctcctccaggcttgcggtggcgtagccccatatgtaatccttttcttcaaacatttccgcaatcggcacggcgccatggccgtacccatccatctttatcacggcgatgatctgcgccccttccccaatccgccgcctcatctgttccatattatatgatacggcatccaggtctaccctggcaaataccctgttaaactgtttcattgctccatactctcctctgttctttttaggcagtccccgattcccgccgttaaatcttctgccagcacactgtaggaacccctggcggctttggcctcgtctcctgcgcaggcgtgcaggtatactccgcagacagccgcctcataaggcttcagtccctgcgccatcagccctgcaatgactcccgcgagcacgtctccggccccggcctttgccatggaactgtttcctgcagtattgacgaatatctgacgatcccacttggccgcaattgtacgtgcatcctttaagacgcaaacaacaccagctctgtctgtaaaagacctggtcatctcgaaacgcttttcctgcagctctgtaacagaacagcccagcaggccggacatttctttcaagtgcggggtcaggacaatgggccgctcccgctcttcaagcaattccggatggcaccccagtatattcagtccatctgcatctatcacgcagggaatctgaacctctttcacgacctgagttaagatactctccgtaacacggctctgtcccagcccgcagccaatgcagaccacatccgcccatgcgaggagatcacgaatggcttcttcctcatattcagtataagtgctgacaatcgcttccggtaaaagctgctgcaatatcacccggttatcttcatgtgtataaatccggaccagacccgcgccgcatctatacgcggccttcgcactcagatatgcggcgcccgacataccgcggcttccggtaatcatcaggatcttcccataggttcctttatgtgaattgggccttcggggcgggatcagctccggcaggtccgatttttcaaatgtgtagcagacacccggttctttttcaaaaagcttccggctgattccgatggatacggcaacagtttttccggcatattggcagcctggatgtaaaacacagcccagcttttcgcactcaaaagtaaccgtcagatcggctgaaaatgccgtccctagtacctttcctgtggctgagcagatgccggaagggatatctatggcaaccttctgccccggcagcgcattcatctttttaatatttgccgcgtatgctcccgagacttcccggttcaggcccacgccgaaaacggcatccactataacagtatattccttcctgctgattgttgttactacaggaacaccgcaattttcagcgattttcatttgctgcatgcagtcaggagacctggattcttcgtttccgatgaaagcggcctcaacatcacagcctttttcttttaacaggcgcgcaactgcaaagccgtcgccgccgttgttgccggagccgcagaccaccagcgttctgtgtgtattgatcttttcctgctccatgacggccactgccgccagagcagcccgctccataagcaccatagagggaatcccgatctcatggatcgtgtaattgtcagctttctgcatccattcaccggtaggcagatatctcatatactcactctcctttatttttatagagtttcgcttgtgaaacccgcgtccgcagcggccgcactggcatctgcctctaataccactgtgcgtatccccaatgggattgtatctgataggcgcacgtttcctaataagcgaaataacgtgcaacgaaggcgcagcacctttgttacacgttttatattattaatcaattatcatgttcttcattgtaacggctgatattataggacagtttcatcaaactatcagacaaatgtacactttctacgatcacatcatccggcaggtgcagatcagtgtgcgcaaaattccatatgcccttgataccattctcaacaagcatatcggctacttccaccgcttttgactttggaatcgtcagtgcggcaatctctatgtccgtattttcaacaaattctctcaggtcgtccatcatacggatcgggattcctcgtattgttaccccttccagtcttggattcacatcaaaaataccctgcagtataaaaccgctcttttcaaaggccgcgtaattggcaagcgcctgccccaggttacccgctcctattatgattacgttatgttttctgttcagtcccagaatctttccgatctctgtatagagatacttaacattgtatccatatccctgctggccgaagccaccgaagttgtttaaatcctggcgaatctgagatgcagtgacgctcatcttcttgctcaggtcatttgatgaaatccgttctactcctgcatccagtaattctcccaaatatctgtaatatctgggcagccgtccaattaccgcacgtgatatctctctatcttccacagctatcccctccaaacttaatctatttcatattatatagaattgtacgggcaaagtcaaattttagttgtattttaaactattttcgttataatgaaataagtatactcaaaggcatcccgcagctcatgccccgcggacaggttttcagcatagctgaaaattaatgcttattttttaagacaacaagcggggttcggcggctgaagtacaactgggaggcccgatacagaagacaacaggaggtttcttatgatacttgcatgccataatctcaataaagctttcggtggacaggtcattgtcagagacggctcttttcatatagaagacagggaaaaagcggctctggtcggagtaaacggggctggaaaatccaccattctaaagatgatcgtaaaggaagagccagtcgacagcggtgaaattgtagttacaaaagggaaaactctcggatatcttgcacagcagcagaaactcgagggcggccgctccatatatgaggaagtaaagacagcaaaggctgatattatcgagttggaaaatcaaatccgtgctattgaaaaggaactgaagtctctgagcggtgaagcccttcagagcaggctcgatacctatcaccgcatgatgtcatcgtttgaggcacagaatggttatgcttacgaaagcgagctgacaggcgtcctcaaaggacttggtttccaggaggaggattttgacaaaaaaacggacaccctctccggaggccagaaaacaagagtttccctgggaaaattgctcctcacaaaacccgatattctgcttctggatgagccaacaaaccatctggatttgaactccatcacctggctggagacctatctgctgaactacccgggcgctgtatttatcgtctcccacgaccgtttcttcttaaacagggtggttacaaaagtggtggagatcgaacatgggactgtccggatgtacgccggcaactacaaggcctatgcggacaaaaagcaacagatccgggacgccatgatgaaagaatatctgaaccagcagagggaaatcaagcatcaggaggccgtcattgaaaaactccgttcattcaaccgtgagaagtctatcaagcgcgcggaaagccgtgaaaaactgctagataagatgacgctggtcgataagccccaggaggcggcgaaggagattcatttttctctggaaccctcttgcctgagcggcaacgacgtgctttcagtggaggggctgtctaagagttttgacagtcaaaccttatttacggatatcagctttgatatcagacgcggcgaacatgtggctgtaatcggtgacaacggcaccgggaaaaccacgctgcttaagattatcaatcaagtggttcccccggatacgggctcctttaccctgggatctaaggtgagaatcggttattacgatcaggaacaccatgtgctgcatgaccaaaaaaatatatttgacgagatttcggatgactatccaaccctaaataatacgcagatcagaaatacgctcgccgcattccagtttaccggtgatgacgtgtacaaactgatcggggacctgagcggcggcgagaagggtcgcgtatcgctggcaaaattgatgctttctgaggccaatttcctaatcctcgatgagcccacaaaccatttggatatcacctcaaaagagatattagaaaaagcggttaacgactataccggtaccgtattatacgtctcacacgaccgctattttatcaaccagacagccacccgcatattagagctggtgaatcagacctttgtaaactatatcggcaattatgactattatctggagaaaaaggaggaactgacggccgtctatacttcccctgcagccaggggaacggataattctggtattccgaaggaatctgtttcagacgcaaaactgagctggcaggaacagaaggaacagcaggccagggagcgcaaaagacagaatgaactgaaaaagacggaagaacgcatcactgtactggaagaaagaaatgaagagatcgatgagctgatgactcatgaagatgtgtattccaactcggtcaaatgccaggaacttgctgcagaaaaggcttccaatgaaggggaactggagattctctatgaaaaatgggaagaacttgcagaataaggccaaaatggggaagcccacttcaactcctttcgaacaaagcgggcaagcccacctcaaatccccatctcctcacttatgaggggcttgcacactttgacgccgccgcgatgccgctttgcggctatataccttatcgcggcgtgtgcatcccccgcagggcttttctgatctaggaaattcctttgaaatttcctagatcagaaaaaaggaccgcatgcagagctgcgtgccggtccgtttttgtattgtagataaaatttacagccttgctgcaatcgctttgataaagtcctcactgttgagaaccgtcggattctcaatcgttgtaatcagcgccagatcttttgtcatgcttccggattctattgtgtcaatggtcgctttttccagtctgtctgcaaatgccatcaaatcatggtttccatccagttctccgcgctttcttaaagctccggtccatgcaaaaatggttgcaactgagttggtggatgtctcctctcccttgaggtgcttgtaatagtggcgctgtacggttccgtgggcagcctcatattcataatatccgtcgggagacacaagcacggatgtcatcatagcgagtgatccaaatgctgaggataccatgtcgctcatgacgtcgccgtcgtagttcttgcacgcccagatatatccgccctctgatttcataacacgtgctactgcatcatcaatcagtgtgtagaaatactcgatcccggcagccttgaatttttcatcgtattcagcatcatagatttcctggaaaatgtccttgaatgtgtggtcatattttttggaaatcgtatcttttgtcgcaaaccagagatcctgttttgtatccagagcatagttgaagcagcttcttgcaaagctttcgatggactggttgatattgtgcatgccctgcacgatacccgggccatcaaaattatgtacgagctcttttgtctctgttccgtcttccgccgtatagacaagttctaccctgcctgcgcccggaatcttcatctctgagcccttatatacatcaccgtatgcatggcgggcaatggtaatcggctttttccagttcttaacgcatggctcaatcccttttacgacgatcggcgcgcggaaaactgtaccgtccagaattgcacggatggtcccattggggctcttccacatctccttcaggtcatattcatccatgcgggccgcattcggggtgatcgttgcacacttaacagctactttgtacttctttgtggcattcgcggaatccacggttacctggtcgttcgtttcatttctatattccaggcccagatcgtaatattccgtattcagctcgatgtaaggctccagaagattatctttaatcatcttccagaggattcttgtcatctcatccccgtccatctcaacaatcggtgtactcatcttaatcttttccatcttaactgtctcctcctaatatttcttcataaccttgtcttttaaggttctgtatgacatgcagaatatgctcgttggcgagctgctccgcaaggtctgcatctttatcccggattgcgcgcaggatctgcttatgctcccggatcgactttctggcccgttcttctgagactacggaagatctccgagccagttggacatatttgtggaaatcggtcagtacatggctgagtatcttactgtttgatgcctcatataaaatcgcatggaacttgccgtccagctcagtcacctgatctgcactgcctccaccctcttttttcatatgaaactcggaaagaagtataatctcgtccagctcatccagctgctcgtccgtaatgttctctgtagcccatctcgcacacagcccctccagcatagaacggatcatatagatgtcacttacatccttcggagatattcccgtcacatatgcccccttattcgggatgatagagactaggccttccagctccagctgcctcagtgcctctcgcacgggcgtgcggctgacccccagttctttcccgatcgtattttcccttaactcatcgtgttccttatactttcccttcaggatatcgtcacggattctctgaaaaacacggctgcctaaggaatggtcctgatattcttccattttgcttttatgtcctcccaagtcagagttttatatgcagttcactgcatacactgtctattttggcaactaattcgtcatctgtcaagactgtaacgcgaccttcttcatattctttgtccacccaggtctttaatgccagcacaagctctgaatttttatccacctgccgttctgcaggaagcttgtagtatgcgttaatccagtatgcaattcccgcaataccggaggtattggagacagatacaagagccgggcggtttaaatatttgtcggtatcaaaaatattataaatttcttcgtttttgagcattccatccgcatgaatcccggcacgggttacattaaaattcttcccgacaaacggcgttctggagggaacccggtatccgatctctttttcatagtactccgccagctctgtgatcacagttgtatccatcccatccagcgttcctctgagctgtgcatattcaaataccatcgcttcaagcggagtatttcccgtacgctccccaattccaaacagggaacagttcaccccgcatgcgccgtacagccaagctgtagtcgaattattgaccgccttatagaaatcgttgtgcccatggaattcaatcaattcactcggaacaccagcatgtgtcatcagtccataaataatccccggtacggatctcggaatcaccgcccccggaaaattcaccccatatcccatggtatcacagacacggatcttaaccggtatctgatactcttccataagcttcatcagctccagacagaaagggattacgaatccataaatatcagatctcgtaatatcttccagatgacatcttggtttcacccccgtctccatacactctctgacaacagaaaggtaatgatccagagcttcccttcggttcatcttcagtttataaaatatgtgataatcagagcagctgaccagaatccccgtttccttcagcccgatctccctcaccagttcaaaatctttcttattcgcccggatccagcttgtaacttccggaaattcatatcccatctccagacatttataaaccgcatcccggtctttattactatacagaaaaaattcactctgcctgatcttccccttaggcccgccaagcttatgtaaataatcaaaaatcgtaactatctgctctgttgtgtagggggcacgtgactgctgtccgtcacggaacgtcgtgtccgtaatccagatttcgtccggcatattgtgaggcacaatcctgtcgttaaaagcaatcttcggaatctcatcatagtggaacaagttgcggaacacattaggcgagtccacatccaccagctgatacatatgctcttccagttccaaaagatttgtgtgtttgttcaaaaatacttttctgtcttccattctaccattacctcctaaatatccagttaacaccccgcagcactttaatcctacggattacatccatgtataattgtatacaattatacattctgtgtcaatagttatttagttcgtgtcttccagctgccaaagtggaggaaaggaaaaagaaggaaaatcaggtctgccccggttttccttctttttttcctttgcccactctgcagccagaacccgtttccaagcccccctgtgttcggtttctttgccatacattagtcactaaagaataactctcactttaagaaccccatcaatactgccaagttcctcttttacagcgtcagatacgtctccatctacgtcaatcatagtataagcatattcttttctgctcttatttgccatcaacgagatgtttaatttttctttagcgagcagtgctgtgaactgtccgagcatgtttggtatattatgatgcaggatggtgattctggagccctcacctttctgtcccatatcacaatccgggtagtttacggaatgtgtaatattaccattttccaagtaatcaatggtttccttgaccgccatttttgcacagttgtcttcggattcctctgtggaagctccaagatggggaattacaattgcccctttgactcctgtgacctccggtgttgggaagtctgttacataacatttcacgtttcctgcaacaagggcatcaaccatgtcctcactgtttacaagcacatctcttgcaaaattcagaataaccacatcttttttcatcaggctgatcgtatctttgttgatcatgcccttcgtatcttccagcgccggtacatgaatggtgatataatcacattctttatagagctcatctaccgtttttgcatggtggatattacgtgaaagcttccatgctgcatcgacggatacgtatggatcataaccgtatacttccattccgagatgtgtcgctgcattagcaaccagaacgccgactgctccgagtcctatgacacccagttttttgccttccagctcggtcccggcaaaagcctttttcttcttttcggtcatcttggcgatgtccccgtcctcttcattctcctgaacccagctgataccgcctattatgtcacgtgctgcaagaagcattcccgcgatcacaatttcttttacaccattggcattggcgccaggagtgttaaatacgacgattcctttttctgcacatttgtccagcgggatattgttaacgcccgcacctgcgcgtgcgatgaccttcaggctgctgctgaagtccatatcatgcattcctgcgcttcttacgaggatggcgtccgcctctcctgcatcttctgttcttacatagttttcattaaatttttccagtcccacctgggctattggattcaggcaattatacttatacattttacagattctcctcctcgaacttgttcataaatgcaacgagtgcttctacaccctcatatggcattgcattgtaaatgcttgcacgcatgccgcccacacttctatgacctttcagattctccaggcctgcggctttcgcctctttaacaaacttggcatccaattcagcatttcctgtaacaaaaggcacattcatcagagaacggtcctttggctcaacggtgcctttgaacatcttgctctgatccaggaaatcatacagaagcgctgctttcttttcgttgcgggccttcattgtctccaagcctcccatgctcttgagccatttaaatacctttccgcaaatatagatgccgtatgccggaggggtattgtaaagggactttgcgtctgcgtgtgttttatatgtaagcatggtcggtgtgccgggcagtacgtcctccgttattaaatcttcacggataataacgatcacaacgcctgcaggcccgatattcttctggactcctccgtaaatcaccccatatttgcttacgtccactggttcagacaggaagcaggatgatacgtcggcaaccagagtcttgccttttgtattcggaagttctttgaatttggttccgtaaattgtattgttttcacaaatatacacataatcggcatcctctgaaaccggaaggtcagagcaatctggtatatatgagaacgtcttgtcttcagacgatgctattttgttaactttcccgtattttgcggcttcactggcagcttttttcgcccactgtcctgttacaatatagtcagctaccttatttttcataaggttcatcggtatcatggcaaactgctgggaggctcctccctgcagaaacaggactttatagttgtcaggaatattcataagctctctcaggtcagcctctgctgatgtaatgatctcttcgaaagcctttgagcgatgactcatttccatgaccgacatgccggttcccttgtaatccaacatctcttctgctgctgattttaaaacttcttccggtaaaactgccggccctgctgaaaaattgtacactctactcatttcaaatttcctcctgcactttttatacttcatcattgataggtttcattacaactcaagccatctctatcccgtcttcgagtactaatggctgatatcgctctcgtcaaaagcttcgctgattgcagctcccggagctaccatgggccatactttatcatcactgtcgatctggcagtcgatgacaaccggcttattcagcgttaatgctttcgcaaatgccgcctggaattcatcctttgtggttacacggatcccttcggcccccatggcctctgccagcttcacaaaatccaccgcatcgttcagaacggtggcggaatagcgctgctcataaaacagattctgccactggcggaccatgccgaggacgtgattgttaatcacaacctggatgacgggaatccggtgccgcaccgctgtggctatttcattcatattcatacggaaacatccgtctcctgcgatattaaccacaatgctgtcgggacagccggtcttcgcaccaagagaagctcccaggccgtatcccatcgttcccagaccaccggaagtcaggaaggtacgcggctttgtatacttgtaatactgcgcggcccacatctgatgctgcccgacctctgttactacgatggcgtccccttttgtctgtctgtagatttcttctacgacataggggcctgtcagtccgtccgtatggtaattgagcgggtatttttctttgtattcctggattttactcatccattcggggtggcactgctgttccaggcctgcatttatcttcttcaggacttctttgatgtcgcccacaacgccagcggtaataatgacgtttttattcatctcggccgcatcgatatcaatctgaagaatctttgcattctttgcaaacttcctggtattgccggtcactctgtcgctgaaccttgcgccgataacaatcagcaggtcacattcgctgaccccgtaattggacgtcttggtcccgtgcatgccaagcatgcccgtatatcttccatcagttcccggaaatgcgcccttacccataagtgaatccgtgactggcgcgtcaactttatgtacaaactccagcagttcttcacttgcacccgataaaacggctccgccgccgacaaagatataagggcgttttgccttattgatcatggtgattgctgtctccacttctttgtcagagacttcctcagcacccatagggatgacgggagcaattgcttcacacttataatcggttttctcacccgtcacatctttcggaatatcaatcagtaccggaccggggcggcctgtctgcgcgattctgaatgccttgcggatcgtcccggccagcttactgacatcctttacgatatagttgtgctttgtaatcggcattgtaatacctgcaatatcaatctcctgaaaactatccttgccgagcagggatacgccgacattacaggtgattgcgacaaccgggatggaatccatataagccgtagcaatgccggtaaccaggttcgtggctcccggtccgcttgtggcaaagcagacaccaactctgcccgtcgctctcgcatatccgtctgcagcatgcgcagccccctgttcatgggaggtcaggatatgcgtgatctcatcactgtgtttatataaagcgtcatagacgttcaggatcgcgccgcccggatacccgaaaacagtatccacaccctgctctttcagacattcaatgacgatttctgctccagttaaatgcattgataaggacctcctaatttgtctttggcacttccagtattgcccctctgttgccagatgtaaccatagatgcatatcttgccaggtatccggacttaatctccggctcctttggatgccatttagctcttctggccgacatctcttcatctgaaacgtccagctccagcttcagctcagggatattgatctttataatatcgccctcctctaccagcgcaatcggtccgcccacagcagcttccggtgacacatgcccgatggatgcgccgcgggatgcgccactgaaacgtccgtccgtaataagcgccaccgtagatccaagcccgtatcctgcaattgcagaggttgggttgagcatctccctcatgcccgggcctccttttggtccttcatagcggatgacaataacatcccccgggttaatcttccctgtcttgatcgcctcggtggcagcctcatcgctttcaaaaattctggcaggcccttcatgtaccagcatctccggaacaactgcggaacgcttaaccacgcttccgtcaggtgcaagatttcccttgagcactgcaattccaccggtttcgctgtaaggattttcaatcggccgaatgacttccggattgagattcgtacagcctgcaatattctcacccacagttttacctgtcacagtcatacaatccgtatgcagcaggccttttttatttaactcattcataacggcgtacacaccgcccgccttatccagatcttcaatgtatgtatggcctgccggtgcaagatggcacaggttcggcgttttttcgctgattgaatttgcaaattcaatttcaaaatccattccgatctcatgagcgatagccggaagatgcagcatgctgtttgtggagcagcccagagccatatctacggttaatgcattaagaatggcctcctccgtgataatatctcttggccggatattctttttcaccagttccattacctgcatgcccgcatgtttagccagctgcagcctggcggagtaaactgccggaatcgttccgttcccacgcagccccataccaagagcctccgtcagacagttcatgctgttcgctgtgtacataccggaacaggaaccgcatgtagggcacgctttattttcaaactcacataaatcctcttcggacattgttcctgccgcataggaaccaacggcctcaaacatgctggaaagactggttctgccgcccttcacgtgtcccgcgagcataggccctccgctgacaaaaattgtcggaatgttgattctggccgcggccatcaaaagcccaggcacatttttatcacaattcgggatcatcacaagggcgtcaaactgatgtgccattgcgagcgcttctgttgaatcagcgattaggtctcttgtgacaagagaatacttcattcccacatgccccatggcaatcccgtcacagacagcgattgccggaaccataataggggttcctcccgccatcgccacacccattttaactgcctcagtgatcttatccagattcatatgccctggcacaatctcattgtaggaactgactacgcccacaagcggtctgtccagttcctcctgcgtcattcccagcgcatgaaacaaagaacggtggggcgcctgctggcttccctttgttactgtatcacttctcatagttttaaaacctccttttctacttatgccattactcctgctgttataactctgatctacctaaatgtttatataggaacagatcttgtcacccatctcactggtgccaatctgtgtatttccttccgacataatatcaatcgtgcgaagcccgtcttttaatacttttgagactgcgttttcgatggcatcagcttccttatccagatcaaatgagaaccggagcatcattgccgccgacagaattgttgcaatcggattggcaatccccttgcccgcaatatcaggagccgaaccgccgcttggctcataaagcccgaactttgtctcattaagactggctgatgcaagcattccaattgatccggtaaccatactcgcctcatccgacaaaatatccccgaacatattctccgtcaatatcacgtcaaactggctcggatccttaaccaactgcattgcgcagttatccaccagcatgttttccaaaaccacctccggataatcggcagccacttcctctactacctttctccacagtctggaagagtccagtacattcgccttatccacgctcgtcactttcttcctgcgcttcatggcaatgtcgaatccccgttttgcaatacggcgtatttccttttcattgtatgtaagttcatcatatgcagtcataaccccgtccacttccacggtctttctctgtccaaaataaagcccgccggtcaattcccgcataatcatcatatcaaacccctttgctgcgatctcagctttcagagggcacgcctccttcagctcatcatacagcacagccggcctcagatttgcaaaaagattcaattccttccgaatcctcagcagccctgcctccggtctcttagatggttccagctgataccacggagaagttgcggcatctccgccgatagaccccatcagcaccgcatcacttgccttggcaagcgcaatcgtctcatccgtaagaggaacgccattcacatcaatagaagcccctcccatcaaaagctgcgtataacagaactcatgcccgaatactgctcccactttatccagaaccttcatcgcttccgtcacgatctccggcccaataccgtcccctttaatcactccgatgttcagtctcataccaaatacttccttccaaatatatatgtaatagaataaaaatgctaatttttatcataccgtatttttcgccacgtttcaaccctttaatgcgaattttgggatgactggggtaggagtgcgtcagggtggacgccggcggcaggggaaggaggggcagctgagggcggaatttggggataagcagctctaaattaaaaagggcggaaaaatggcgggcaccgcagccgccctactccccctgccgccggctgtttcatccggccggcacataaagtcccatcccatggagggtttcgaagtgagagcagcggatgtgccctggcaaagtgaatctttcaccagacaggaaattagcaaatcagcagatcagtaaattccacgccgtctcctcccaacgcagcccatataagccaaccccatccgccgccctccccagcctttcacctgctgaatagccgacctcccgcccggatgggcctagcccgtcagggaacacatggtgattcccggggcatctaagtgcgcggttagaaacacttacagcgaaaaagcagcagctgatggatgaaaactgattaccaaatcagttttcaaggccgcctgagcttagaaatcatcagatttctaagtgaatgcggctggttccatcagctgctgctttttcgctgttagtgtttcttcgcaaacggcctgccccgggaatcaccatgtgttccctgacgggcgtccctcaccccgcggatccctagcctattcagcactaggcttctcgatctgggcaattgccgctttctgcattggtatcctgcagtttttattgttaccaaattctacgattacatcgtcatctgtgatatcaataattactccataaaaaccgcttgttgtcaaagcggtatcgcctacttccattgtggaaagcattgcctgtactctcttctgctctttcttctgagggcgcataagcaaaaaccacataccaccaataataacaacatagatcaggataattccccccatccctgttgctccgcctgccgctaataatccattcattttaaatcctcctaattactatctctacaaacaataagtttactatacacaaaattggacaattcttcaagtatcttttggaatttcactaaatttttatgcctctttcataccttccattccatccagcttctttttcttatacgctttatactcgccggcttcaatggccgcccttatttcttccatcatcgtgttatagaaatagaggttgtgcaggacgcacaggcgcatgcccagcatttcttttgccttgaggagatggcggatataggctctgctgtagcttctgcaggcggggcactggcatccttcctcaatggggctgtcatccagttcaaattttgcattaaacaggtttagttttccgtggtttgtgtagacatgtccgtgtcttccgttccttgtcggataaacgcagtcgaagaagtccacacctcggtctacgccctcgagtatgttggccggcgttcctactcccatcaaataagtcggcttttccagtggaaggtaaggtacaacggcatccagaatacggtacatgtcttcatggctttcccctaccgcgaggcctcccacggcatatccgtccagttcgagctccgtaatctgtttggcatgctcaatccggatgtcctcgtagataccgccctggttgataccgaacaacatctgctgcggattgatcgtatcgggcagggaatttaggcgtgccatctccgtcttgcaccgcctcagccagcgggtcgttcttgccacggaatccgtcatatacgctctgtctgccacgctggagggacattcgtcaaatgccattgcaattgtagaagccaggtttgactggatgtgcatgctttcttccggccccataaaaatctttcttccatctatatgggaatggaaatgaacgccttcttccctgatcctacgcaaatcagcaagggaaaacacctggaacccgccagaatccgttaaaatcggcttgtcccatttcataaatctgtgaagcccgcccagcttctttactacctcatcgcctggacgcacatgaaggtgatacgtgttggaaagctccacctgcgtcttaattgtctgaagatcatctgtggaaactgcacctttaatggcggctgcagtacccacattcataaataccggagtctctatcactccgtgaaccgtatgaaaacggccccgcttagcaagaccgtcccgttttaataattcgtacatagtaacctcatctgttatataatttttcaagcacttaataatgtatgatcacaggtgtgcccattccgatcatattgaataaagcctcagcctggccatatggcatgtttatacatccatgggaaccaatgcttgtatatagagagcccccgaatccaggctgccatgtggcatcgtggaaacctattccactccaggtcacacgcatccagaaactgaccggcgtctcgtattcaggttctcccgtgtcggggtcaatctctccgaccagagtcttatttcgctggatctccagaatattatagacgcccgcaggggtttccttctccggtgtcggataacctgtaactacatccgtctcaagcgcaacggcgccgtctacaatataccacatatgctgggcagacagatccacttccgcataggtgttcccccagtccgcaggcgcatgtgcagctgctgtctgatagtaagccggttctttttctgccgtttccccattcttgatgctgttggtcagcgcttcgaattcggtatcctcatcgatggaccagccataagtgcctccggatacttccgcgctctttccggttggagtaacgattgtcctggtcgtccccactgtatcgtatttgtcaccaaattcagtcagccaggatttgaccgcctcttcgttaaaggttacgttcatattctcatcggcggtaacccatgtggagatcagtgccttatcaacaacttcccgctcggtcattgtatatgtaatacttgccttacagtagttattcatggtatcgcatgccttttttacttcctcggactctgaggtaaatcttggctctgcataacatttttccttttccatatccagttccgtctgaaactcggaaatatactggtgcaccttttccttcagcacgtccatatttactgcggtgccgatcacttccggttctatgacaaacttctctccgtcaaactttggatacgcggactgtgcgggaacctgttcagcagtcactgcctggagactctgtatcttagaatccagcgcagactgatcataggaaacctcaaccgtcactttcgccgagttctttgaaaagaaagccgccggccagaggaaaccattctgctttttcaatgcttgcttgatatcatcattttccttgtaggttaatgagatctcgcttccggcaatcgtgtcggacttattgtccttttctttgacttccagcttatagccatcgacctgttctttcatgtatgcctctacatccgcaggggtcttacctgaaaaatcatgcccgttaatctcggtgttcataaagaaatggctcataaagaatacggagacaccaatatagaccaccgctacagcagccacaacgctgcctgtaattatccagagctttttcatactcttcttttttctgcctttctttttcccagacttcttatttttcttctttggctcttcctcctcgaagatgtcttcaaattctatctcctcgtcttcctcctcaaactctccgtcttcctcgtattcatcttcataatacctgccgctgccagtatcgtattccgcgtccttctgtacggaggaacggacttcgatcacatcaggaatcacctgggttctggccatatcccggggctgctttgcctgccccctgccggtatcagtgcgggcatgctcttcttccggctcctcttcctcctcttcttcatcgaagaagtagtcctcatcatcttcatctatctcatcgtccagaaaataatcctcagctgcttcatcgatctcatcctggtagtatttctcttctttttctttatcttctgggtgaatgctgtctgaatttgtcttattcctgtcgctcatctagtattgctccctcttttttaatcaatatctagtccacattatattacgaaacaagggaaatgtacagtaaaaaagtatgaatttaaagataaattaaggattgcacgattatataacttcttatataataagtctatgtgcaaaaagaaaggagtatttccatgagtggttcaacatttggcagattatttcgggtaacaacctggggggaatcccatggtgccgctataggcgctgtaatcgacggctgccccgcagggctccctttaagcgaagcagatatacagacatttctggaccggcggaagcccgggcagagtaaatatacaacaaagagaaacgaggcggatcacgtagagattctgtccggtatcttcgaaggcagaacaactggcacaccaatttctctcatcgtccgcaatcaggaccagcgctcccgggattatgggaatctggcgtacaccttccgtcctgggcatgcggactatacttttactcaaaaatatggcatacgcgattaccgcggaggcggcaggtcatcgggcagggagaccatcgggcgtgtcgctgccggcgcagttgcttccttattattaaaagagcttggaatcgggctcatttcctacgccaaatcgatcggcccggttcacatcccggaagaagattatcattttacggaaatcacagaaaacagcctctatatgccaaacaacgaggccgctgccaaagccgccgaacatctggatactctgatcgcggatcaggattcctgcggcggcacgattgagtgccgggtaaccgggctgcctgccggactcggggaaacggtattcgacaaactggatgcgtgccttgcaaaggcggttatgtccgtaggcgcggtgaaggctgtggagatcggggacggacttcaggctgcatctttgacaggaagtgtcaataatgatgcatttgcttccgaaaacgggagaatatataaaaagacgaatcattcaggcggtgtgcttggagggatgagcgacggatccacgctgatcgtccgcgcagcggttaagccaacgccttctatttcccagacacagcagaccgtgacggaggatggggaagagacatccatatccatccatgggcgccatgatcccatcatcgtcccgagagccgttgttgtcatcgagtctatgaccgcccttacattggcggatctgcttcttgagaacatgggaagccgcttggataaagtgaaagcttattatacggaggagaagaatgtccaataaactgattgatattgtaaacatcacaaaatcatttgatgagaatgtagttctggatcagctggatctctatattcgtgaaaacgaatttctaacgcttctgggcccaagcggctgtggaaaaactactctcctgcggattctcggcggttttgagacgccggattccggggatatcatcttcgatggaaaaaacattaataagctgccgcccaaccgccgtcagctgaacactgtcttccaaaaatatgccctattctcccatatgtccattgcagaaaatatcgcctttggcctgaaaatcaaaggcaaatcaaaaggttatatccaggataagattcgttatgctctgaagctggtcaatctcgagggatatgaggacagaagccccgactccctgagcggaggccagcagcagcgcatcgccatcgcccgtgcaatcgtcaacgaaccaaaggtactgcttctggatgaaccactgggcgccctggacctgaagctgcgccaggatatgcagtacgagctgatccgtttaaaaaatgagcttgggatcacgtttgtctacgtgacccacgaccaggaggaagccctgaccatgtctgacacaattgttgtcatgaaccagggttacatccagcagatcggtacgcccgaggacatctataatgagccgcagaacgcgtttgtcgcggattttattggggacagcaacatcctcccggccactatggtggaggataaggcggtaaagatgctcggaaccgtctggcagtgcgtggatgtgggcttcggcaggaacaagcccgtggatgcggtgatccgtccggaagacatcgacctggtaaagccggaggaaggcattatcgagggcgtggttacccacctgatcttcaaaggtgtccactatgagatggaagtccttgcgaataactatgagcttctggtacacagcacggatatgttcccggttgggaccgaagtgggaatcagagtagatccatttgacatacagatcatgaaaaaaccggagtctgaagatgcggaggcggtaggaattgaagagtagaaaactattgagcggcccctatttattctgggcggcatcctttattatcatccctcttctcatgatcgtgtattacggactgacggataaagagggaggctttaccttactgaatctggcacagattacaacgcccgagaatctgaaggctctcggcctagcgctgctgctttccttcataagcacactgctctgcctcgtactcgcataccctctggctatgattctttcggaaaaaaatgtaaatcagaccagcttcattgttctgatattcatccttcccatgtggatgaattttcttctgcgcacactggcgtggcagaacctgctggaaaagaacgggatcatcaacagcattctgggattcttccatctcccggcacagacgctgattaatacgccctatgccatcgtactgggcatggtatacaattttctgccgtttatggtgctgcccatttacaatgtccttgccaagatagacaaagacgttatatttgctgcacgcgaccttggggcaagcggtatccagacattttcaaaaatcatactacccttaagcgttccgggcatcatcagcggagtcaccatggtgtttgttccttcgctgacgacctttgtcatctcggatctgctgggcggaagcaagatcctgttaatcggaaatgtaatcgaacaggaattcaaacagggaagcaactggcacgtaggttccggtctttctcttgttttgatgatttttattattgccagcatggcgctgatcgccaaatacgataagaatggggaggggaccgcattttgataaaaaacgctgcaaaacgcttttacttaatactaatttttatcctgctctactctcccattgtaaccctgatggtgctgtcctttaacagttccaagacccgttccaaatggggaggatttacgggcaaatggtacgccgcccttttccagaaccgggatattatgaatgcgctgtatacaacgctcatcatcgccctcgtttcggccctgatcgctaccatcatcggaaccgccgcggcgattgggattcaggccatgaagcccaaattccgcacctttttcatgggagtcaccaatattcccatgttgaatgccgatatcgtaaccggtatctccctgatgcttttatttatcgcattccgcttctcactagggttcaaaaccattttactggcccacatcacgttcaatattccctatgtgattcttagcgtcatgcccaagctcaagcagaccagcaaacacacctatgaggccgcgctggatctgggggcttccccggtatatgccttcttcaaagtcgtttttccggatattatgccgggcgtattttccggttttcttctggccttcaccatgtcgctggatgactttgtaatcacacattttacaaagggtcctggggtggataccctctccacgaaaatctacagtgaagtcagaaaaggcattaagcccgagatgtacgcgctgtccaccatcatgttcgtgacagtcctggttcttttgttccttgtaaatgtaacccccgataaaaaggaggctgcaggcgaaaagcggctcaaaatccagagaaagcacaaagtatcccgccttattttccgtaaaatactgcccacggccatggtgatcgttatcatagcaggcggctttttctacggctcccaaaacagttcttccggaggcaatcaggtgatcgtctataactggggcgaatacctggatcccgaggtaattaccatgtttgaagaagaaaccgggatcgatgtagtctatgaggaatatgagacaaacgagatcatgtatccaaagatccagtccggtgctattgcttacgacgtggtctgtccttccgattatatggtgcagcgcatgattgaaaacgacctgctctcagaaatcaactttgacaatgtgcccaacataaaatacattgacagcacctacatgacccagtcccgccagtttgatcctgagaacaaatattccgtcccctatctcttcggcacggtcggaatcttatacaacaaaaccatggtggacgaacccatagacagctggagcgtcctctgggataaaaaatacaaagacagcatcctcatgcaggacagcgtccgtgacgctttcggtgtcacgctcaaataccttggctattccctgaactccacagacctggacgaactggaggccgccaaaaagcttctcatcgagcagaaaccgctggtacaggcatacgtagtagaccaggtccgcgacaaaatgatcggaaacgaagccgccataggcgtcatctattccggtgaggcgctctacactcaggtagaaaatccggatctggaatatgtcatcccaaaagaaggctctaacctctggatcgactcctgggtcatcccgaaaaacgcaaagcacaaagaaaacgccgagaaattcataaactatctctgcctgcccgagatagccaaaatgaacttcgactacatcacctactccatcccgaactccgaaggacgcaaactcatcgaggaagactggatgaggaacagtgaaatagcatttcctgatccggaagatctcaaaaactgcgaaaccttccaattcctgggggatgaaaatgatgccatttataaccaactttggcgggaggtgaagtcggagtaggggggacgctgagcgaaaggagctgggggcggggcttcctatgctgtttttggagcccggccgcttgctaagaatccgtaacagggaaaatgagggaaatgaaggtactagtcgcatttggcgtgaaatctgatgatttcacaccgcaggcggctacaggatttgatttggtaaatcaaatcctgcccttcatttccctcattttccctgtaacggattctaagcgcgctatgagggttccaaaaacagcataggaagccccgcccccagcccctttcgctcagctagtcgcacccggtaggtaggacggcttgcacgggagtaaatggacggggacagcgtatggtaaggcccgggtgtcacattgtgcctgcgctatgttgatctgtcacaagcaggccccgcttccccagcccaatccgcctcccccgtcagattcccccccctataagcggcattatttccgccaggatgcgccagcctgtctgaggagggagttcagccgggaggcgggggactttgcatgtgctttctgagaagcatagagagcgccgtgtaaccccttaataaaaaccatgccggatggaaaggctaaaatctgcttcacaaaagcagattttaaggcggcctgagccgcgcaattcatcagaattgcggggtgaatgccgccggtgcctttccatccggcatggtttttatttaggggttgcaggcaaacggacagctttcagaaagtacatgcaaagtcccccgcctcccggctgaactccctcctcagacaggcgtcccccctagccaaaaattcccgcttacaaaaaatctacacattgaaacagccccctccgatgaattctctaagcaaggagtttgtgggcacggactcactcccaatccccacaaagtaatcaaagaatttcaggagtctttttgcctctacgtattcagggcagtcttttcccattccgaacagcaggggctcaacgtactgttttaggacggccagttcatataaaagggaagaattgaacatgacgtctgcttcttcctgatacgggaagatgttctcctcctctcctttccttaccgacggccatctggcgatggtgtttttggcggagttgcctcttgttctggcatctcttacgatacggcgtatgagacgcccgtcggtggacggaattcggttgtgttcgtcaatgttcagctgggtcagggcgctgatgtatatcttgaatttgttgtcgttgtttagtgattctgtcagcttagggttcagacagtgtattccttcaatgaccaggatatcctgtgtgttcagtttcttgggaatgctgccgtattctttctttcctgtcttaaaattaaaggtgggcaggtatacctccctgccggagagaagggcctgcatgtcttcgttgaactggtctacatcgatggcttccagacattcgaagttgtattcgccgttctcatctcttggtgtgcgctcacggtcaacaaaatagttatcaacggcaattgggtgcggctgcagcccattgacgcggagctggatggaaagccggtgtgagaatgttgtctttccggaggaggaaggccctgctatcaggacaaacttggcctccggcctgtcggctatctgcttggcgatctccccgatctggcgctcctggtacgcctcctgtaccagcacgacctcgctcatatcatgctgcgtcaccatatcattcagggctccgaccgtatcgatgccctgcatatctccccagagaaccgatctttttaatacctgaaacagctttggcctgggtgagaatggctctacagtctcaggcgattccagcgtaggcatctgtataataaacccttcatcatacaggtagagtgcataatacttcagataccctgcatccggcaccatatatccgtaatagtagtcttcaaactcgttcatactgtaaatgttgactttggatactctcctgtattcgaacagcctctctttatcaaacattccgtgtttccggaaaagctcgacggcttttgtggtatggacggagcgcttctcgatccggattttctccgcaacgagttccttcatgcgctcatccacttgatccaggaattcctggttgagctccacatccccttctaccgtacagtaatatcccttgctcatggaaaaatgaatcctgacccgctccactttgtcatggcctccgacgtcgtgtaccgctttgacaagcataaagcacaggcttctcttgtaagtctcatatccgataggatctcccgttgtgataaattcaatctcccggcagtcctgctccagttttttatccagttcctggagatggaactgattgataaagacgagcacaatctgatgtccgtatctggcctgatattcctgtgcaatctcctgataagtcgttcccaccgcgtattctttcgtctcttctccgatgcgtactgtacaagttgttgattccatagcattcctttccgcagttttcctgcctcttgttccattgcctctgattatgatatgccggcgtatccggtcgttaacgatgatgaaatgttcctttacagcacctggaacggatggataatgggtgctgttaccactttcagacagggcagcctggtctgaagaaattgtttcatatcttctataaaaatatattctgtcccgtaatggcccgcatcgataactgcaagcccctgtcccactgcatccaggccctcgtgatggccgatgtcgccggtaaccagcacatctgcccccgcctgtatggcgggtacaaccgcggtttttcccgatcccggagagaccgccagcctgccgacttttttatccagatctccaaataccttcaccgagcctaattccagtttattctttacaaaagcgcagcattcctcaagtctcatggtatttttcaaagtgccgaccctgccgatgccttccggcacaccgttcgtctctgaagtgatatccagtacctgtgcgtcttccagttccagaacctttccggacagatctgccatccccaggacgtcataatttgtatgcattgcatagtaagaaatgtcagactgtatgagacttacgagccttttaccgatgaaatctccgtccgtaatacgttttaaaggcgaaaaaatcagcgggtgatgggtaatcagcatatcagcgcctgtttccttcgcctgctcaatgacctggtcggtagcatccagtgcaagataaatgcagtttacatccttgtcagagcgtccggccaacaggcccacattgtcaaaatccagtgctgccgactttgggtaagccgcctctattatcgtcatgatttctttacattgcatagtaatccagcccctttctcacatattccagttcttcttttaattcaccgaatcgccgcagagccttttcactgctctgcccctccagtcctttgagtatctctgacttcagagacatctcacgttcgagaaatgccttcagcacgggatggcgtctctccagcaggtattttccgtatcggatctccacatcactccagcattcagagtgagagtttcgctccccgaatgttctcaccttcatcataggataaaactttccatcctcaagtaccatatcttcccggataaacaaaaaaccttcctctaaaagaaaggctctaactcttgctatttccgactgcggctgcaggataaactccttcatgcctgcggtgacatccggactattcttcagaatccggatcatcaggccgccgcccatccccgcaagtactgctgtctcggcctctccaggccggagggcacacaggccgtctgacagcctcagctctatccggtctgacagaccattctcttccacgtgttctcttgcacggacaagcggcccttcgttgatatccatcgcaaaggccgaggggatcactccgtgtttcaccaaatagatcggaatataggcgtgatccgttcctatatccgctgtaatatatccggcagtcgccagagcggcgactgcctgcaatctctttgataattccatacgcccgtacctagtccagataatccctaagcttacggctcctgcttggatggcggagcttgcggagggctttcgcttcgatttggcggatacgctcacgggtaacgtcgaattcttttcccacttcttcgagagttcttgccctgccgtcattcataccgaaacgcagacgcagtactttctgctctctctccgtcagtgtgtctagcacctcgtccaactgctctttcagcagggtctgtgccgccgcctctgccggaaccggcacattgtcatcctggataaagtctcccaagtgactgtcttcttcttcaccgatcggagtctctagtgacacaggttcctgggaaatcttcaaaatctcacgcacacgctctacgggcatgtccagttccttcgcgatctcctccggcgtgggttcacgccctaattcctgcaaaagctgtctggatacacggatcagtttgttgattgtctcaaccatatgcacaggaatacggatcgttctggcctggtctgcgattgccctggtgatcgcctggcggatccaccatgttgcataggtactgaacttataccctttatggtaatcaaacttttccaccgccttgatcagacctaagtttccttcctgaatcaggtcaaggaagagcattccacggccaacatatctttttgctatacttaccacaagtcggaggttagcctcggcaagctctttctttgcatcctcgtctccctcctccatacgctgtgccagctcaatctctctctccgcactcaaaagcggaaccttcccgatctctttcagatacatacgcacaggatcttctatactgacgccgtccggtacagaaaggtcgatattctccatatccacctcttcctcatcagtaatgatgacttcaacgtctacgtcatcatcatctccgctgattcgaagcacatcaatattatttgactcaagatggtcaaataccttttccatctgctctgcgtccaactccatatcattgaaaaagtcattgatttcctgaagttccaggatgcttttctttttcttgcccaacgcaacaagttctttcagcctctcgtcaaatttctgtgtgttttcttccatgtgtccatccttcctttgcctacggccggtataccccggtatagggctatcttgttttattttatccttattcaatagaaatatgcagtttctttatatcatcaagtctgcgcttctcttccatgagcctctgcagccctgccatatccgtcggatccaggtgcattgtccggtcgtcgatgctgtgtctctttacacgcagtatcgtttccttcaaagcctgctcctgctcctcttttgttgacagttctctgatctttgtatggaataaagaagcggcttccctgtgctcttcttccgctgtaaagtgattcaatatctttgccgggttcagttcccctgagccgtactgctcataaagcagctctgccaccgtcctgtacagctcctccgtaaagtcctccgggcttatgtagcgcttgatggtaccaaatagcttctcgtcctcgatcatccatgtcagaaggatcttctgggatacgagaataccgttctccttcggctttccccctccggatgcctgtcttggccttgctgcgggctttgccataccttcactaatggcggtcttggtcacaagcttttgcaggctgtcctcactgaccttgtaggcttttgccacggcttcaatatagttgtttctttccagttcatcctcaaatccggtcagccgcttagctgtttccttaaaaaatgcggtctttccctcaggggattccatgtcatagtcctttgccagaatctcgaggctgaacaaaaaaccgttccttgcactgcctatccgcttttcaaactcttctgcccccaggttcttaataaattcatcggggtctttatagggatccatccggattacttttgcggaaattcctgcctccttcaaaatcggtaccgcacggagcgctgcctttgtccccgcctcatcgctgtcgtaagtcagatagacctcttgtacataccgcttaatcaaagaggcatgtccggttgtcagcgccgtaccgagggaggccaccgcatttgtgaatcccgcctgatgcagggagatcacatccatatatccttcgcatatgagaaaataaggctttcttgaagtgcgtgcccggttcaggccgtacagattgcggcttttatcaaaaatcgccgtctcgggtgaattcagatacttaggcttcccatctcccataacacggccgccgaatccgattacacggttgttcacatccatgatcggaaacatgacccggttccagaacttatcgtatacaccgtttttctcatctgtattgatcagcccggcctggcggatcagatcctcactgtaacctttctttctgagatactggaacaggtcattgctgtacttgttggagtaacccagtccaaaagccttgaccgtgtcatccgagagttccctgttcctcaaatatgtatatgctgctttgccctgctcagattttagctgcacataaaaatactgcgccgcagctttattgatctccaaaagcattgcgcgtaagtcggctttctctttggcttctttcgaatattccatttccggaagctccacgccagccctgtcggccagaaactttacagcctctataaacgaaaaattctcgtattccatcagaaatgtaaatacattgccgccagcgccgcagccaaaacaataatacatctgttttcctctgctcacagaaaaagacggcgatttttcattgtgaaacggacaaagcccaaaataagaactcccttttttctgcagccgcacataaccggagattacatccacgatgtcatttttcattcttacttcttctatcaattcttctggataatacatttattcctccataaaaaaagccctatatattatattcgacaaaacattctgatttcctttaatttttccatgcttccggaacaaaaaattcttcatacttttttaccgcataattatcggtcatccccgctatgtaatcgcatacaatctgctccctgcagctgtccgtcctgtcaatcgcctgcaggtattgcaaggggagctgttcgatatgatggatataataatcatacagctgttcaatcaggcgcactgccttgtcttcctccccctttgcctttggattcaggtaaacattttcaaacatgtattttctgaggccgatcattgcagtttccacctcttcggacatgatgatcgccggtttatccatactgtggatgatcacgtcatgtaccatggtgttcagacgttctttgctggtattaccaagaaccctgcgatattcgtaagggatatcttcctccacgagaatgcctccccggattgcatcgtcgatatcgtgattgatataggctatcttatccgaaagacggagcacctggccctccagggtgcggggagtgcctgctgtgggatggttcaggatgccgtccagtacttcccatgtcaggttcaggccggctccctgcttctccacacattccacgactctcacactctgttcgttatgggaaaaatggtatacgcggttcagggcgcgctcccctgcgtggccaaaaggcgtatgccccagatcgtggcccagtgcaatcgcctccaccagatcctcattcagcctgagggcttttgcaatcgtcctggcattctgagagacctccagcgtatgcgtcagccttgtcctatagtgatcccctttgggcagcagaaaaacctgggtcttctgcttcaggcgccggaaggatttgcagtgcagaatccgatccctgtcgcgttgaaatacgggccggatatcgcattccggctcctgccgctttcttccctttgaatttctgctaaacgttgcataagggcttaaatattctagttcccgttcttccagctgctctctgattgtcataggcttattcctcacactgaatcctgactgcaggggacaaaacataatcttccataacaaaatacttctatatataatatattctgtgtttacgatttatttcctttttattggtatctgtacagaaacatgagcaacagttcagacctgtctgaactgttaccatgagccgttactcttcttgttcttttatacgtttttcgattgcctgcacaaccgtctccagtacttttatacgggcataatatttgtcgtttgcctcaactacaacccatggggcatattctgtggatgtgcgtatcagcatctcgttgaccgcttcctcatactgatcccacttctcccggttccgccagtcctcatccgtaatcttccactgtttctgcggattttcctgacgggccctaaaacggcgttcctgctcttccttgtcaatctgcatccagaatttaagaacaatagtcccggaatccgccaggtcacgctccatatcgttcatttccttgtacgccctctgccattcctgctttgtacagaacccctcgatccgctcaaccataacgcgtccataccatgtacggtcaaagattgcgatgtgccctgccttgggcattgccgtccagaacctccagagatagtgatgtgctttctcaatatcattgggggacgccgtcggatttaccacaaatcctcttggatccatttttgcagttagtcgtttgattgcaccgccttttccacctgcatcccacccctcgaaaccgagcacgaccggaatccgcctccggtataattcgctgtgaagaagactcatgcgtttctgcagttttttcagcttctctttatattcttctttggtcaggctcaaactcaaatcagatttggcaagaacagactcctgcagttcttttccgttgatctcctgtttgggaatttctgtgccactgcaagcctccacgtccatctcggcaatcgcctcggctgctttctcctttgcccttgccttttttactttttccagctgttcctccagggccttgatgacaaccgtatagatcttcaccgcagcaaactctttatccattgcttcgataatggtccacggcgcatagtccgtatctgtgatctgaagcatctcctcgatcatctgcgtatactcacggtattttacattccgctccaggtcgccctggctcacacgccatgcagtctcttttgagcttctgagcttttggaagcgttttttctgttccttctggtcaattgcaaggagtaatttgatgattgcggtaccgtcgtccgttaactgcttttcaaacgaacagatggactggtaggcatcgggaacctcttttttccgtgttcttttatcaaaacggtcgatcagcacctttctgtaccagctgccgtcgaatatggcgatcctgcccttttcgggagtttttgtccaaaatctccataggaaaggatgcagccgctcttcttctgactcatccttaatggcaaataccttaaagcccctggggtccaggctctggatcaattctccgatctgcagccctttcccagctgccccatatccttcaaacacgatcatcacagggatattcagagccttgcactggcgctgaagttctcccatccggctctcaagcatcggcattttcgctttgtattcttctttcctcattgatttggtaaggtccactttctctaacataattttctcctcccgtccattactgattttagtattcacgagccagttcatttataaacgccggcatcttgtacaatgtcagatgcactccttttatgtcactaattataccacggtttccgccttccggaaaagaatttcgccggtcaccaaaggctgccttttatggaatccgcctgttttcctgccatggaattatttatatgcacggagttccatcatattcttgtcaactacgattaaaaatgatatacttttccaaacattttaattcgcagcagtcaggcaagcctgaactgtcttcattcttcaaagggggcataatcatgactgaagtacagtattccaatgccagttttctgcattcggcactgaagccttctgagcagttagtctatatgacatccgctgcttttggaaaaaactgggcatacacgcttcattctcacagttttgcagaagtattctttgttacatccggggaaggtgtattctattccaacgatgcggaggttccaatccggaagaattcgctggtgctgatcaatccaggcacgcctcacacggagcgctccagcggaccggagccgctgacttacatgattatgggaatcgataatctcttctttcagtttctggataacagaaaatttcagtttcatatatatgagcttgaggaatttggacatacgatcatgccggttatgaatttgatgttggaggagacaaagagcagacagcagtcctcccttcagatatgccaacactatatgtccgttttttttctgaagatccagcgtctcataggcgaccggctcgccctgtatacagcggacagctttccgcctgagtgcgccgccgttaaagattatattaagctccattttgccgaagatatcacgctcgataccctggcggagttttccggttttaataagtattacctttcccgcatattctccaaaacttatgggattgctccgatcaattatcttttagaaagaagaattctgaacagcgaagagctgctcaagacaactgatttcagcatcagtcagatatcccgtcttgtcgggttctcctctgccaattacttttcccaatctttcaaaagatataccggaatgacacctctctcctaccgggaaacacattttatataacaagagtaacccaacagacagcctgccggggcagcttcaggaaaatacaagcacaaaagccatgccgttctgctgcttttctgcaaatatttcgccgcccatctttcgcataatctcgcggcaaatatagagtcccagcccgctgccctgtctgccttcactgttttgggcacggtaaaagctctcaaagatatggttaaaatcattatctgtcacgggaattcccgtattgaatatgcggatcagctggcagtaatcctcctcataaaaggaaatctcaattttcttcccgtccccgtatttgaatgcgttttcaaatacattttcgaacacctccaaagcccgttccaaatcgcccttcaacaggcggttttcatagttgccaacgtacagttccagcatgcggatgctgcacttttcacggtaagtcacgaggacccttgtgagaagctcctccagatagaattctccgttatttacggaaatatccagaatatcctcccgggcatttttcataatttcctctacatagcgctcaatttcctctgccttctccccaatctgccaaactgcatgcttcttctgcccctctgtttgatacagatcttcctccagagcctttccacaaagccggatggtgttcaacggcgttttgatgtcgtgtgaaagggataagagaagcagctttttctcccgctgcaattccagctccctcttttttgttacatccagtttgtccttaagctggctgatcccccacataaagtgcccgaagaatctgcttttttcttcattgaccgcacctttaaagtgtccctgagccagttcataagtaaggctgctcattctctggaagggccgtatgagctggtatttcagatagaataaaatcaacagtatgcacagctccatgattccaagaaaaagctgcgtccacaaaagaatccttctctgatcaaagccaggcctgtcatagtcaaatcgtaagaatcccatcaaacagtccgccgtatacaagggccggatttccgtttcgccggcatcatctcccctgtagaattccgatgtgatatcctcgctgtccagattttccaaagaaagaaagcttacaccccgtacatatttgtaagaatgcaaatcaagcttatccagaggttcaccttcagataagctgttgtaaatgcggtttatttcaaccttatattcttttttcctgtctgccggctctttataagagatgcctgcagtccacagtgccgccagcatatacagcagcacggaaagggcaatgagcctgttaaacttcttcatagcggtaacctactccccagactgtctgtatccgcccgggctccctgggattatcttcaatcttgcttcgcagcatcttgatgtgtacggtaagggtctgattctcactcaggctgtccattccccatatctgtgcgaaaatatattcttttctgagcgtcttccccgggttttcgagaaacagaagcagaagctcatactccttcacattcagttccagttcctggccgttcagataggcctgccttgcacttgtatccaggctgattttcccggatacgatcagatccgactcctgacgtccgccataagcacgctgcatcagcgctttgaccttagcgatcaaaatctctgcgtccacaggcttctccatgtaatcgtccgccccaagttcatatccggtcagtttatcagccctgccgtcccgtgcgctcatgatgagcaccggaagattccacttcgccctcacagcacggcagactgcaaatccgtccatttccggcagcataatatcaagaagcagcaatttcacaggctgcccctccatgtaatccagcgcttccgtcccgctcccggcccaacagacggaatatccctctctgttcaggaaatcccgtatcagaaccgccagttccttattgtcttccaccagtaatatatctttcatgtcttaccatcccaatttgatcagccagtcatttaaagttctctccctggccctgtcctcctgcgcactttcccgtcttccaagggtgatttcttcacggatgtcgccgtcttcaatatacagtaccctcccgcattttgaagccactttcatatcatgggtcaccagcatgatcgtagttccctctctgttaatatggttcagttcctccattacctcaagggaattctgcttattcagcgccccggtgggttcatctgcaaatatgattctgggattgtttatcatgctgcggcagatgcacgcccgctgaagctgcccgcccgatacctcgttgacatcattttccgcaatctcactaattcccagcttgtgcatgagcagtttcgccctctcattgagctgctttctgccactctttgtctttccctccgccgtctggtacccgggtaaaataatattatcatataccgacagatttttcagcatatacatctgttgaaatacaaaccccatctcattcaggcgcacatcgctcatatctcctgctttcagagaagtcagctcccgtccaaaaaagtccactttcccggctgttgcggaatccatgccgcttatcgtatagagaagcgtggtttttccggatccggacggtcccataattcccagcatttccccctcatggatcgtcagatttacgttgcgcagaacattgttctggcgcttctttattatataggttttacacaggttcgatacctctaatgtcttcatattctattcctcctactccaggttattcagttcgcggatattgatctctttcacgttcattgcagcaataacagttgccaggataatcccaacaagcaatactccgggataagccccgtatacctgccatggcaccacctggatcttcacgtcagcacccataatcgcaaaaataggcttcagcatgaaacggttggataccagtgacagcgggactgctgcaatcatcgagataagggctacccataccatacgcatgacctgccacaggcggatcgtcccgcttcggtatccaatactcttcatcatggcgatctcccccttttcgcggactataaacagtcgttccatcagcagggtgatcagcataatcactgcgcagagcattccggtcatcggaaccagcatatccttcagagattcctggataccacccacattccggtccaccacatcctgggccgtcgtccatttatagtgtgggaacaaactgctaagctctgtaacaagctcttcctgcgtctgatccgtctccatatccaccataatgttccaatagtgaaacatggtttcatctttcaatatcagtttcggattcattctggcactcttgccaacttgcatgtagtctgaatatgatcctgttatgataagctgcttctgctccccgccggcttctacttctaccgtgtcgccgatctgccatccattttgctccataatatttcttgaaaatgcaacctcattggacagacgcggcgcatccccttcctgataagagagaaagtcctggttcggaccggctatctgcaccgtcataatattgtttttaccggtctctcccccggaggaatagcgcaggaaatagatcggtactccggtaagatcagcttcataccccttttctgccagttccgtttctactctcttcatgccggcatccagatctttcctggttctgtaaagattttcgccgtagttttctattttttctacataaacagagctgttcgggtccatacagaattttccggccatctcatcgcttttcatcgtgttcagcgtattcaaaggtattgtaatcagtataaaactcagacaaaaggtcacaatcagcacaaggtaccgctttacatggctcgccatgtcattgaatccgagaaacagcgccaccggcatccgttttctgcggtacaggcgaagccccgcccgcctgccatagcgttccccgctctggcctccacgtattgcgctgattgcagagattttattcagctttctcgtacagctgtagcagaaaaacataaccaggattacaatcagcagcgtacagacaccattcacccacagattaacccgggtatcttccataatcatattgccgctgacggatgcgaccatcattctgctgacaggaatacttgctcccagtcctgccgcagcgccaataaaaacgatcaggatatattttataaggtaaagctttttaatcgcaaaattcttaagtcctatggctttcatgataccgatctcccggtactcttcttctattgtaaataccagcgtgaaccgaagcaccaaaagtgctatcaggatcaggcagattccgatcaggatcagcaggcccgccataatcatatcgaaagaatacgccatcgtataagtacttttggtaatcgagttcatggaagtcacaaaaccttccgcgtcaaatccgcggacaaacctgttcacatcctccacattaaagtaatacagcccaatgaggttagcatcctctctccccgaaaagaatttataatccgctgggcagacaatcatccggctcataccggccatatcgctcccgaaagcagcatccttgatcaacagcttaacggtaaacagcttctcagaaccgcccacgctgagtttcaccttgctgccttcctccagcttatttttaccggccattgccttccccagcgcaatctctcccttttccaggctgaaatccttcccggccgtatcatataccttgcagtaatcggcatcctttgtgcccagatacatgctcgccccatgcgtattaaaagcctgatcttttccgtctgcccggatccggatgtccttttcgttcagcataataaccgtattatagccccactctttcacgcccggggcatccttctcaatccagctgtcgatctgttccttttcctgggtacccgagataatataattcacatcgggtacattggcataatccatatagtagttcactgcagaagacactaccataatattgttgatgctgcttgacagaaagatggacgcaatcataatgaacagaaaaagaatgatattaacgctctttctcctcttcagatcctttttcaatatcctctgtatcatgtaattttccttccctttcattggtgataaggagagtatagcgtactgtttattaaaaattccttaaatgagaagaattttgtattccaaatgattcgtaacaacaaaaaaacaccattcatatagtatcatacttatggctgaattagaaaatgctatcaaatattaccatcccggaggaggtgatattacactgaaaagtacaataggtgttgggactacgatcaccattatcttataaaatctctattttaaagccaaatacaggcctgccgcataatccttggcaaaaacgcagactataagttagtatttacttttactatttgatcaagattgcatttcagatacacaaaatataacaatcaattggagggaaatgaaatgaaaaaaaaatataagatttttattgggatccttatcctctttttctgtatagctgccggaggcttcctctattataaaatggctgccccgccgggtgaagaatggctggcttatcataacgaggagctgatatctaatatcgacagacagctttccggtttggatatcgacagtatcgtccagaataaggaaaagtttgtgattgaaaaagagatcacagatattcaggatacaataaaggctggccgacttacctatgaggagctgacagcgatctgtctttataggatcaagaccttggatcaaaaggaacatggtcttaattcagttctgaccatcaatccccatgcaatggatgaagcccgccaaaaagatcagatgtataacaagcggacagaagttaactccgagatattcggaattccggttctgttaaaagataacatcaatactgctgggagccccaccagtgcaggtgctgctgcattggcagattttattcctgccgaggatgccgatgttgcggccaatttaaaaaaacacggcgctattattttaggaaagaataatctctctgaatttgccggatatatgtccagtacagcccccgccggatacagtaacgcaaaaggacagaccatcaatcctttcgggcctttaaagatctctgcgtccggttccagcagcggaagtgctgtttccgtaactgccaatctggcccctgtatctataggtacagaaacagacggttccatcgtcgcccccgcatccgcaggatcagtagttggctttaagcccacccgttctacagtctccggcgcaggtatccttcccctcataaaacagatcgatacccctggcccaattgcaaaaaatgtccaggatgcagcggttgtatacaatgccatgtctgatcaggccatcacccctgtatgggataaagattttctgcaagataagaccattggattagccagctatgaatataatgacaaatcccaggtaagtattttaaaagaagcgctccagaatgcaggtgcaaaagtcatcgatatcccactcagccaagaaggggtcttagtcttcagcaacatccatttgactctcaaaaaagattatgaagactttgccagtatctatgatttacctgtcaagacgctggataacttgataacccttaatagtaaagataaagacaaaaatgccaaatacggtcaggactatctggaagaagctgcgaagactgcaattactagttctgatgagatcagcaaaagtatagaaaaagccgcatctcttcttgaaacagcctttaaagaaaacggtctggacggcattgcgtttttgaatagcactgcctccactttaccagcagcggcaggcttccctgaactcacgatccctttaggaaaagataagaacggtgtaccacagggagccacattaaccgttccatccggcgaagatgaaactctgttaaaaatgggttatagttttcaggaatatacaaagggccgcatatatccactgggaactccctaagtccaatatggaatttactctgtgaacactgaatggaaaagctgtagattttaccaacaaggagtaagctgttctggatgaccgcatatatcattcgccttcttaagaacgccagtcatagtagctctgtctgcctgagcaatcatctccaacaccctgctgttcacctattccaaagcctatgaggttctcatccagacacttcatgatcttatctaaattcatggaaacaagactttcttcctcaacaggatcaaatcataagagcccctccggtacatctcaaacttttctattgcctggcctccatctatggctgtatccatctcagttcctgcgatattgcggatatggctggcagtttccagtccatccacgttcggcatcttccaatcaataaaacagacattaaatggcttctcctgtttctttgaggcttcaataagggagaatgcatcgatcccactatccgtccattcctcctgtacctgcaattttcgatgaaagtaaaagtatatctgatttttctctgggaatgaagcaacggctgggcattgaattggagctgcttaacagccctaagttgttggttctcgatgtaaactggtgcagcctttttggctgtgtattcagtgcatagagtaaaaaagaatggaatataggtactgaatgcacagtcgatacaaagaaatgtgtatgaagcaagaaagaaatatgaatatctgatatgtgtgaatagaacctcatagctagttttttttattgtcagatatgcacagttcacccattaagtccattttccgcaagacttcttcgcatttatttaccccaatccccagaagcgttgcccgtacttttaagttttcgaatgccgtcaaattctcatacagcgggggattcgaataatgaacctatatccaacaaatcttttccggtccaagggtgatgattaaataaagtgtcaccggaagttgggctgataattcctgttatcatttttaataatgtggatctccagcaccgttaggtcctatatccattgattgctccctcatatcagtatatccacagtcaagaactgtggtaacgattccttctgttgatacagctttggaaccatttctgaatactgacttgcatttttgatgatagttcttccatatcagaacttcgtattttcaacttttaagagtaggcttcaagaagtctaaaagctctagcactaattattgcggagttttaggggaaaagaactacactatgttacgtgacgtttacaatgaaaggcttacagagacaacagaaaaagaatactgctataaaaacaatatccctggtctgtttgatattcaattattgaaatccgcatattatttgcaatcttatttaccagccatctgtttttccgcaaaataaaatagccaaaagctccaacaaatcaaagctttcagctatccgcccttaatgcggaagatgggacttgaacccacacgagcgcattgctcacaagatccttagtcttgctcgtctgccagttccgacacttccgcattttgtagtgctgtatctcaactgcgctacgaatgatatcttactatttatttccgaaaatgtcaacagatttttgtaaattttttgtataattttgaaaatttgttaatgcaatccctccaacccggatatttaagggacttggagggattaatgaattaatttttttataccatgttgccctcaaatttgggtattccatcaaatcctgtctgaagatcttcatccgtaggaatataatcggtcatttcattgttatggaatttttcatatgcaagcatatcaaaatatccggttccagtcagtccgaacagaatagtcttctcttctcccgtctccttgcacttcattgcttcgtcaatggcaaccttgattgcatggctgctctccggtgcagggaggatgccctctacccgtgcgaactgctctgctgcctcgaatacggatgtctgctcaacagaacgcgcctccatgtatccgtcgtgatacagctgtgacagagtggagctcattccatgatatctcaaccctcctgcgtggttcgcagatggaatgaagccgcttcccagagtatacatcttagccagggggcagaccatgcctgtatcgcagaaatcatatgcaaatacgccacgggtcaggcttgggcaggatgccggctcaacagcgataaactgataatcagcctctcccctgagtttctctcccataaacggtgagatcaggcctcccaggttggaaccgcctccggcacatccgatgataatgtccggtttgattccatatttgtccatagcaatcttcgcttccacaccgatgatggattgatggagcagtacctgattcaatacgcttcccagcacatatctgtatccttcagtatgtgttgccacttccacagcctcggaaatcgcgcatcccaggcttcctgaagtgcccggatgctcagccaggatcttccttccgacctctgttgtctcggatggagacggtgttacacttgccccatatgtccgcatcacttctcttctaaacggcttctgttcgtatgagcattttaccatatatactttacaatccagatccagataggagcaggccatagagagggctgttccccactggcctgcgcctgtttctgttgtcacacctttgaggccctgatccttcgcataaaaggcctgtgcaattgcagaattcagtttatggcttccactggtattatttccctcgaacttgtagtaaatcttcgccggagtctgcagcttctcctccaggcagtatgccctgacaagtggagccggacggtacatcttataaaaattccgtattttctccggaatctcaatatgacggttgtcattatcaagttcctgtttcaccagttcatcacagaatacaacccccagctcttcagcagtcataggctctaaagtccctggattcagaagcggggccggcttattcttcatatcggccctgacattgtaccactccttcggcatctcgctctcttccagataaatcttgtaaggaattttgttttcactcattttataaatctcctttcttttttagggataagcctttttatctgcataaaaaaatactcctatccctcacaataaattattgcagggacaagagtatgaatcatcaaaactcctgcggtgccacccagcttgatgcggcgaacgcatcctctcatgcatactaacatatgctgactttgttaacggagtactctctccggctcacctactgtaactttcagttcgccctcagaagcccattcccatctgccttgtcccgctgcaatcccaccgcctgcagctctctgtgtggtaagtacaaaaggtacttgctcttcctcataggtttgataaatactttactacgggaactttcaaatgtcaatacttttttttaaatcgggagttagttaacgagctttagactcgttgacggacggggacgcttcatgacagggaggccggggaggtgctggggctgtatatgccgttgcgatatgcacccatgctgctaagtgattctagaacacccgatgccggataggcgggtacgctgaacacattacgggaaatctgatgatttcccgcgctgggttcagcaaaaacttgatttggagatcaagtttttccccgcctatccggcatcggctgttcaagaatcactaagcgcactccagcatttcgcaacggcatatacagccccagcacctccccggcctccctgtcataaagctggctcatccaatcggcaggaaagctcgccaaccgggtgggttcccgaccagggcagcggatttggattggctatgcgtatcttttcatcttcaagatgtgtattgaattattttgatactggaaccgtatcccattgcttatgtacacctactgggggcataaaagtcccgccaattcaataccatacgttgcccccgcttgaggcctctccttagaaacgagcttttttctgccggttggatgcgacagctccatgaagggatagctgaaagcctcccggagaacatccatgtcctttcaaaaacgctcaaagcggaccttagaaattcttggtgggaaacagcccggaaaatggagagatttttggattccgaatccaaaaatcagatgacccagcgcgagaaatcatcggatttctcgtgatgtgtcagtggtgctccattttcagggctgtttcccgcctagaatttcttaggtccgcggccgcgtttttgaaaggacatggatgttctccgggaggttttcggctatccctttatggagcgcccccatccgcgccgaggctaaagctcgtcgctaaatcccgatttaatagcgattatgcacatcttccgcaaagcacataaagtcttttaattcgataaacatcccgttatccagtattgccctgccgctcagcttcccaaagacctgatgctggtcagaggcaattaccagcgctgatattttggccgcccgatccaagaccggttcaaaatccatctcgaacctgccatcgctggatgtaaaacgccagggcttcatgtaatcgtcctttggtatgtgaaatgttacatcatccagtttatgacatacgccgtcatagaacagaatattttccgttgccgcagacgtgtcaccgaatccataacctatattaaaaccaaagggccttcctcccacagttccgtttcctgacccccagtaccagcggttgtcataggtccatacgccgcgtccccagtccagggttccgtaatccgtctccgggcagaaccagtaggtggtttcatcaaacgtcacggatccttcggcgcgcatacagtttattttctggttgtaataaaaggctgtctttttgttcttccagggcgtggctatgaccattgtgtccatcggtggctgagaaagagttatctcacagtataagggctttccatcccagaagtccttgaaatcacaggtaatcgtccgctttccgggttccacgcagaattccatcttcaggcgtttatctttgtaacggatatttccctctgacgaagtggatggcatcttcatcttccccatgggaaatttatttagaatcgtctcggtgtgttcccatccttctttaaaattcaggagagagactgactgaaggcctatatacccatcgtccgatagcgtaaatgctgctgcgaagtcctggttcagtaccagataataatcccattctttgatccgcagcttagacgctttaatctggtttcggtcatattcctggataagctgcctggaccatcctggttccctcaggcttccgtctttatttaataaaggctgctttgttgtaacttcatggtttctcatacaaacatctcctgtccatccaaatcccatataaaaaatgaaaaaagcccgagtccctaggggattcgggcttcatagtattattttactatgcaatctttgcttttgcaacctctgccagtgtagcgaaaccttctttgtcgcttactgccagttcagccagcatctttctattcatatccacttcagccagtttcagtccatgcataaacttgctgtatgacaatccattcattcttgctgctgcattgatacgcgcgatccataactgtctcatctgacgtttgcgctgttttcttcctgcataagatgatgtaagcgctctcattacagactgttttgcaactctgtactgtttggaacgtgctcctctgtatccttttgctaactttaaggttctattatgtttttttctagcgttcataccgcctttaactcttgccatttcttaatcctccttcatcaacttccaaatcttacagatatggtaatactttcttcatgttttttacatttgtagcatctgtgatagccgggtgtctgagatttctttttctctttgtagacttctttgttaagatatggctcttatatgctttatttcttttcagttttcctgtacctgttactttgaagcgctttgctgccgctctattcgttttgatttttggcatgatgtatttcctccttcattgtgcgtttactgagtgtataaacacccgtaataatatatttttaacgtttttcagttaaaactatgctcatgcttcttccttcaagttttgcaggtttctcaataaccgcaatatctgaaagcatccgtgcaaaatcgtccagaacatgtctgctctgctgtatatgagccatctctcttccacggaaacgcagtgtcactttgactttattaccttttgcgatgaacttctttgcattgttaacctttgtatttaggtcattcgtatcgatattaggtgacagacgcacttcctttaactcgacagtcttctgttttttcttagcttccttgtctttttgtgtctgctcgtatttaaatttgccataatcaataatcttgcagaccggcggtttcgccatcggtgcaatcttcaccaaatcaagttccgcatccatggccatcttcagggcctctctggatgacataatccctaactgttccccatcctcactaaccagacgaacttctttgtctctgatctgctcattaatcattaaatcgctaattgttgtatacctccatcaaatgaatttccttcaggttcttccgcgatagcaaattgtttcataggatctgatttcctataaaattaaaaaaacgagtgaacatctccacccgtatattgacatacacagccaatgaccgtgtaaatgtttcaatatcaaaccaatagtcacccgattgtgctatggtgagagtggatactctactttattttttgcctcacgcagattataatttatcatattttcaggtaaatgtcaatagatttcctcttaatttttccattaatctatgttataatattgctacttttacagaaaagaggaatgactatgagtagtttacagcaaaatggggcaaagagcaagccgtcagaggacaaattcaaaaataaatggggatttatcattgcctgtatcgggagttccgtgggcatggccaatatctggctctttccctatcggatcggagaattcggcggatttgcatttttaattccttatatcctatttgttgtgctgatcggccttaccggagtgattggtgagatggctttcgggcgcgcaatgcagtccggaccgttgggcgctttcaaaaagggatttgcgcagagaaatgcaccgggtcttggaagcctggtggggctgattccggtcatcggctcccttggaatcgccatcggatatagtgttgtcatcggatggatcctgcgttttcttttctcttctataacaggggacattctgggttccagggaaccgggagaggttttcggagcgctggcgcaggatttcggaagtataccctggcattttctgggacttttgattgtcctggtctgtatgtcctttggcatctcacacggaatcgaaaaaatcaataaagtcatgatgcctgcattctttatactgtttatctttcttgcagtacgcgttgccatgctgcccggatcattttcgggatatgcttatttattcaaaccggactggggagccatgtccaatccaaagacctgggtttttgcaatgggccaggcattcttctccctttctcttgcgggcagcggcacggttgtatacggaagctacctgaaaaaggacgtggacatcatcagctgtgcaaaaaatgtggctgtctttgatacgctggccgcgcttctggcaggaatcgttattatcccggcagttttcgcttacggcatgtctcccgattccggtcccgggcttctatttgttacgatccctgcagtcatcaggagtctgcctttcggccgcctgtttgcagtggtattcttttttgcggtactctgtgcaggggttacctccctgatgaaccttctggaaagccctgtggaagctctgcagagccgttttggattttcccgtgtaaagtcgattgccatcatcggagtgatcacactcggcatcggtatctttgtagaaggtgacctgctcagcatctggatggataccatatcgatctatgttattccgctcggcgcccttctggcaggaatcacgatgttctgggtctgccgcagaggttttgccctggaatctgttcaggcgggcagaaagaaaagggtcggcaaatggttcgaacccatgaccagatatgtattctgcggtgttgccgttcttgtatatattcttggaattttttacggtggaattggttaattccacttgtcaacagccgcgcttcatgtcataatatagccattagtgtctaatattacgggtcaaaatgaggaggtttttttatcaaatgaacgaaaacagaagtaacttcacgagcaaaatcggctttattctggctgccgccggttctgctgtaggtctcggaaacatatggcgtttcccatatctcgtagccaaatatggcggaggaacatttttattatgctatattatccttgctataacttttggttttactcttatggttgccgaaattgctctcggccgcaagacaggcctgagtgcaatcggagcttttaaaaagctcgataagcgttttggatttctcggagtcctggccgctgtcgtaccgatcatcatactgccttactattctgttatcggcggatgggttatcaagtattttgctacttttgtaacagggggaacaaaagctgccgcaggagatgactattttaccacatttatcggcggagtcaagagcccgatactatggtttgcattattcgttgttttcacggctgttgttgttattttaggtgttgaaaagggaattgaaactgtcagtaagttcctgatgccggtactcgttgtcctgaccatcggtatctcaatctacgttttaacaatggacggagccatggaaggcctcaaatattacattatgccccacatgtccgacttttcggtcaagacattgcttgcagccatggggcagctcttctattccatgtcacttgcaatgggcattatgattacttatggatcttacatgaaaaaatctaccagcttggagggctccgtgcggcagatcgaaatattcgataccggtatcgcattctttgccgggctcatgatcgttccagccgtatttatcttttccggcggggatcagtccgccctcagcgcaggccccggacttatgttcattacactgcccaaggtatttgctagtatgccaatgggaggatttgtaggaaccgtattctttatactggtattctttgccgcagtaacctcagccatttccttgatggaaacaatcgtctccatcctgatggaccggttcaagtggaaaagaaagttcacttgtatcattgtagtaatctacgtactgctgatgggaatcccctcttccctcggattcggagtctgggatttcatccagcccatcggaatgtctatactggacttctgggactttttgagcaacagcgtcctaatgccgatcgtagcactcttcacctgtatctttgttggttttttcatcaaacccaaaaccatcatcgaagaggcatccgcagaaggcgcagcctttaaaagtaaaaaacttttcacagtcatgataaaatggatcgcgcctatcttactggtacttatactaataagctccgtaatgaatgccttagggattatgagtctctagggagagctccagaagaggtcgctaagtgaaagacgggtgtgggggacggggggcagtggatctttttgaatacacggaacgaaattataccggtaggctatgcatatgtctctgtcagttaacaaaacaacaggtatttatgttacgtgtatccaaaaaagatccactgcccccgtctcagagccccactagaggtgaggattgatctgccttgatgcgtccagcctgcctggaatgtggagcgggatgtcccgggataaaaaaggatgggggctggatgcgtagagaccgcggttagaagtccttacgtaaaagaagccgtccatgagggctgggaagtgattttccaaaatcacttcccagtacaacctaagacgggaaagcatcaggctttcccgttgcatgttgtacgtgccctcatggacggtttcttttgcgttagaacttctccgcggacgggtcgcatccagcccccatccttttttatcccgggacatcccgctccacattccaggcaggcgtccccataccagccacatcccctcgcactaacgctcttcccccatgtagaagatggctacgactcccggccctgtatggcttccaattacggttccgatattgttgatcaaaacttccttggctccgagtttttcttttgccagttctgccacgtactctgcttcttcgatgcagtctccgtgtgtgatcataaccatgtcattgtcccagccctgggctctctctgcggccatttctacaatcttgttcagcgaacgcttgcggccccgctcttttgcgattacctgcagcttgccctcgttgtctacgtggatgatcggcttgatcttgaccatggtacctacgattgccgtggcctttgatacgcgtccgcctttgtgcagatgatgcaggtcgtctacggttacattgtggcagatatgcagcttgttctcttctacccactgtgcgatctcatcgatattcctgcccgaagccttctgttgcagcactttgtagaggagaaggccttctcccaggcatgcacagagtgtatcaatgatgatgaccttggcttccggatacttttccgccagctcttcccctgcaatcctcatactgttgtacgtgccgctcaggcccgatgagaatcccagatggagtatgtcttttccttcttttaaaaatggctccagagctgccttggcttcatccggattcacctgggaggttacggacatatgcccctctctcaactttgcaaaaaattctttgccggtgagaccatacatatctgtataggtttccccgtcgattgtatattttaaaggaacaaccggtacattcctctcttctaaccattttcttggcaagtctaccgtactgttaactgtaattataaattctctcatatccttccctcctgaaatttaagctttacctatcatatcatttttttcgtcagaacgcaaaatctttttggccgtaaggaaaaagagaagtgctgagatcgccacggaagtaaaatcagctatcggttcggctctgtagattcctatgactcccatgaacttcggaaggataatggcaagtggtatcagcaggatcaccttacgcaaaagcgcaatgattagtgagacttttgcctggcccagagccaggaatgtggtctggcacgccatttggattccaaacaccgtaattccgaggaaatataccggcattaccttacaagtcagcgcgatcagttcctgattgcctgtaaacagtctggcgtatattgccggatttatgacagcaagcccggccaataggaccgtggcagacaaacatattacgatcatccggacaaatgcacctcttactctttccagctttccggcgccgtaattatagctcatgatcggctgcactccctgggccgctccctgcacgggaattacaatcagctgcatgatgcttgacataatggacatggtgcccacgtacaaatccccgccgtatttctgaagaccggaattcaaggtaatcatcacgaggctctccgtgctctgcatgataaaaggagatacaccgagcgccgctatgctccccactgttctcgcattcagacgtatatactgtctgcggatacgaatgacgcttttctttgaagtcagaaaccatatcacccaaagggcgcttaccgcctgggaaatgatggtggcaagagctgcaccccgcacgcccattcctgcagcaaagatcaggatcggatccagcacgatattaatcacagccccaatcagcacggaaaacatggcgatcctggcattcccctggccgcttataaacgtattaagccccacggcgaactgtacaaatatggttccgatcaaataaatacttatgtactgttccgcataaacgatggttgtttcgctggcgccaaatgcatataatataggtgttttaaatatcaaaaatccgactgtcagaatcaccgaaaaaatcaacagcaatcccacgcaattacccagaatcttttcggccccttcgtaatttttctttcccagttgtatggatgccagcggtgcaccgcccatgcctgcaaatgcactgaaggccgcgatcaccattagaattggaaaggtgacccctactccggtcagtgccatgtcgccatagccatgaatatgccctatataaatacggtctacaatattatagaggacattgataatctgggctgccactgccggaaccgccatctcggcaatcaattttccaagcggcgcactgcccagcctctcgtcctttcctggattaccagcactgtctgctttttcaatttccctgttctcttccaactaaaactacctcttttcttcacatgattttctacatgcctctgccccgccaaaccggcttttaaggtctaggctgattccggctaagaagctgtgctgtaaaccggaacaatgaatatagtataacacactaacattccggattctatatggaacttcttattagcctgtggtatactaaagtctaaaacaaaaatctattctttaaaatatgctttataaaaggaggtcgattctcattaaaaacatactaaaaaaagccggttactttcttatggccctgcttccgctggcagccgccttcgcaatccagctctttgccagcctgatctgctccttatgtcaggctctttatatgcatttcttttctacggggggttttgacatagacgcgtttggttacatcttacttgattccggctttaatactaaaattatgctcttatacagcgcggttaccatcctgcttctcggaacatggtatcgcatcgcagcggttcccaaagggatgctgcggcgccggctgggacagattttcaacgccaggatgctgctggcatgtttcatcctgatggtttccatgcagtacattgcttcatatctaattattgtgattgctaatttccggcctgactggtacgaaagctataaccagctgtttgagagcgccggcatgaacgatatgacggtgcttctgaccgtttatactgtaattcttgcgcctgtctgtgaagaactgattttccgtggactgatgcttcatttttttcggaaggcactccctttctgggccgccaatctgttacaggcagttctctttggcgtctatcatatgaatctgatacaggggatttatgcatttttaataggaattattttgggatgcattttaaaattggggagaagtatctatcctgctattctgtttcatatcctgttcaatctattcggcagctatctggactttttagttgtttacacaagcagcccccttctctttattatggtggcagctgcggcagttcttctgacagccgccgggcttcgcctgtataaaaagggagctgatatgagagagatacagcgaaggtgataaaacggtatgccctgcctttcccatattgcttcggaaagaacagggcattgattttcaggatgctttaccgctgattctgctactgtagttttatattaagatagtttcttccggataacgtcttattaaatgccaggaagcatacgatcagaatgcatccgatcacaaacccaacggcgttgaagcaggcagtcagtatcagcagcaaaagccgcatgaattttagtgcataccccagttcaaagttgggctgcgtatagtttgctaccgcaacaaaagccatatagagcatcacctctgaattaaaccagcctgactttaccgagaattcgcccatgacaagacccgctattacactgagcggcgtgctgagcatactcggtgtattcagtgccgcaagccgcaggccgtcaatcgatagttccagtattaaaagctggaatatgagcgggatattgaccgtatcttttaccgcaacaaatgcaaacacatccggcagccagttcgggttctgcataaacagcagaaaaacaggagtcagaaacaccgtgagtatggtgatcagcgcccgggatattttgaggtaaacccctgtaagggtaggaaagtagtaatcatttgcctcctcaatcatatcaaatatggaagtgggcagtatcattgcggaaggcgaattgtccaccattattacgacctttccctccagcaggcaggcagcagctgtatccggccgctccgtaaacttgaattttggaaatggattgaaccattttcgcttaaacatggcatctgccaggctctgctgattcatcctcagatcatccagcttcaggttcttgattctctcctgcacattcttaagcagttcctggtctacgcggtcagacatgtaacagagagcgatatccgttctgcttgtctgcccggcttctaccatttccataatcagatgggggtcacggatcctcctgcgcatcagtgccgtattgaacacgattgtttctacaaagccatccctcgatcccctgagagacttatccttgtccggttcttcaacgcttctggcgggataagtgcggcagtcgatcgcaatacacacctcatatccatcaataaacagacatgttacgcccgaaagtatatttcgaagtacctggtcaaaatctccgataatgtcgacctccacatagggaatacactgctgggcaaatgcggtggcgtcctcaggcatagcatccgcctgaattccgaaaaatgaggtcatgatcttcagcatggtctcatctttcgtaaatccatctataaaataaaaacttgccttttttcctcctatgagcatatcccgttgaatgacatcaaagctttcctgaaccggcagaacctgattcatatattctatattttcttggaaggagctgctgacttttttcgtatttttctcaatcatggaatctctaccctttctcttttactgtcctttggaaacagataatctctatggttagaatccccggttcttcctgatttatgcaatcgattaaaaagagcgcgtcctatgaattggtttcccatcataaaacgtgctcttgatatctgcttttttatcaaagatttttctttgttgtacttccaaaaccaccgttcctggtctcggtggcatcatcatcgacagtaatgccgtattcggtgaatatcccctgcatgaagccttcgcctctgcctatatcgacgaccttttcttcgttcgtgtcattcgttattttcgaaaaaatatgtccttcattatcagagtagaagtaatcgctgtctataattcctaccgtattattcagctgcagcctatatttgaaacccaggccgcttctcggataacacttgagaacccaggagttctccatctctgcacggataccggtaggaaccttgatcgtctggcccggctccagcaccaggcggacaggggcataaaaatcatagcccgcagaacctgctgtcgctcttcttggcagcttgattccgtcatatatttcctggatatctgcttcgtcttccagtccaaatgtatcgatccagtcttttttaaactgctccagactcactttatgaaatttggcaattctctgcatgttctttctcctttgttaaccttaatctgctgctctatcgcagcctccaccgctgcatatgtattacgcagtgctctttggttatgagtcgtgcaacacaatctgctgctttttcaggctttcctgaacgtcaattaccttctggtttgcactgcccttccagtgcagctgcgtatccttttggtcaatttcaaaccttccgtctacgataacatccagatattgcattacaggcaggtctttgacctcttcccactcaaagccggtatacagccactgggttttgtccggaaatcttgcacgtatttcttttgcaagcgctgtgatacattccctgctggcagggaacagcggatctccgccgctgtatgtaataccgctaatataatctttttccagctgttcaaataattcctgctttgtttcttcctcaaaggggagcccgccgtccggatcccatgtaacaggattgtggcattccctgcatccgtgtgaacagcccgctgtccacaggacgacccgcagtccatcaccgttaagcatgtcatcttttgtaatattgtgatactgcatgttacatacttttcctttccgcaatctctgccatcttggcatcattaagtcttgtatcgcctttcactctggagtaggacaaataaccgttcatccggtctatcttggtcagattcttacttccgcacaccgggcacacatccatatccagttcttcatggccgcagtcatcgcagtaagataaggacaaattgacgccctcgtagtatcctttttccatcgctcttctgaccagcgccttcacggcttccgtattgtagctgatgggatacttcacatactgaatcttaccgccgttgctcagattccagaatcgtccctccagatcctgcttctcaatcggagtgatctcttcgctgacatggcagtgaaagctgttgcttacatattccctgtcggaaacattttcaataatcccgtattttttacggaactgctgtacctgcaccccacagagattctccgccggcgttccgtaaatcgcgtacagatgcccgtcttcttttttgaattcattgaccttgtcgttgatgtaattcaacgtttccagcgcaaatgagccgtcttctgcaagggacttcttgttatggatctgctgcagttcattcagggcagttatgccaaatgatgcggtggcagattttaacagtggcttgatcttatcatacagccccaggtgaccgccatagaagccgccttcacagtatgcgagcggattcgtggatgccttcatctctcccagataatcgtaggtcctctgatgaagccttctgatcaggttcatataataatccagcacatcgtggaagttcttactctcttgctgtgcctttgcataaatcattggcagatgcaggctgatggctccaatattgaaccttcctacaaataccggtttatcgttctcatctgccggttccataccgcctctttcataccatggagacagaaatgcacggcagcccattgggctgatgattttcccgtattttttatagatacttggaacatatccctcgcctgtcaggctgagccagtcgggatacatcgtctttcgggaacattcaattcccgcttcaaatacgtcctccagcggttttcccggcccatgcaggttctcatcgtataagaatacaatcttcgggaacaataccggctttttatgtccctctttcccctgccccttccggcgtacttccagcattttttttgtagccaatttgccgtattcgctggttcgtgtacctgcactcacggtaataaaaggatagtctcccctgcttgaggatacggaattaaacttatattcccatccctggaaaccctgctccatctctttttccaggtcagcccaggcaacctcctgcaccttatcctccggtagtcccaggtttctatatttctcaatcagtttattgtgcgatttttctgcgtagggctccagaatctcgtccacactcggcaccgtgaagccgccgtactgctggcttgcggcgctgagcacgatgtctccgatcacatcaaaagccgtatccagtgtctttggctcattgtaccagagatttcccatctcaaacccgccgtttaacacgctcttcacatcaaagaggcagcagttcatggtgtctcttctggcagacatatcatgtatgtagatgtacccttccctgatcgcctgtatctcctcaacggtcaggaaaaacttcttatataactccttattcaattcgttgaaaatcaggcttctttttgtggaaacaagggcgctgtctgtattgctgttctctttgtctccaatgtacataatagactggctctttttataaacctcgtccagcatctgtacaaagtcctgcttataattccgataatccctgtagctcttcgcgacaaccggattcactttctccagcgccccctccactacattgtgcatctcagcgatcgggatgtccgttatagccatggactgtaccttttcttccacaaagcggcagatataatccagttcttcatccgtaaacttgatgagtgcgcggtaggccgatttgttcaccgcaacaaccactttatgcacgttaaaatcttcttttgttccgtccttttttactacatgcatcatgatgtcttcttcctttcctgttgtcatttattctatatttagtattcactgcgcaattcgcaaactatatcctgtgccgtacaaacaatactaccactatagagcctgcatcgtcaatacaaaatctttcacaaaaaaggaggaggataacgaatgaaattttgttaaaaaataaactggtaacttctggaaacaatgtttagttccagatcatatcacgccggatatctgatagagtgaacgccccacacatagacatggtatcttttagctctgcttcaatcctgttgatatacgctttgacaccgtcttcctcgccgccgtataccgcggtcacgaatggacgggcaatcaggacagcgtctgccccgagtgcaagtgctttaaatacatcgatccctgtccggattcctccgtcaacaaaaatcgtcatctctcccttcactgcttcgacaatagacggcagaacctccgccgttgacggacactgatccagcacgcgtcccccatggttcgatacaacgatcccctggacccctgcttcctttgccttaagagccgccctgggtgtcataataccctttaagataaacgggatctcggcaatcttcacgatctctttcaactccttcacagacttgcttcctgcaggaggattcagattctgcagaaagggaaggcctgccgcatcgatatccattgccactgcaaatgcgcctgacttcttcacaagctccatcttttctctgattgtacccatatcccacggcttaacagtgggaatgcccatgccgtcaagtttcgtgatcgcttttgtggcttctatcatgacattataatctgtcccgtcacctgtaaatgccgctatcccattctgtgcacaggcggaaaccaatatgtcattatactcctggtccgaatatttatcgccgtagtgcagcttcacagcgcccaccggaccggcaaaaaacggggcggtgaattcttttccgaacaattcggtctctgtcttcacctgcttctgcccgcagagggtatccatattgatacggatttcctgccatttctgatagtttcgtgctgcgaggtcaccgactcctttagatcccggtcccggcattgtatttctgcacgcagctccattgcaggtattgcatgccttacagtaaggccccatacaagatcttgcatttttgattacttcactgtactccatattcattttctcccattctaatagaattctgcggccatccgcagagacacccgcagagcatatgctgcgcaatgccctgcgggtacgaattttcaaacacgttatagtatagcacttctggatttattcatcaataacaagtgagcgttccctccaccttacagagctccgccttccactcagactgtttctggttctgcatagccagacagtaaaaaatctgtttcacgctcccctccaggtcctgcctgtatgtgataacctgccttctcccggcctctggaaaatcatcaatccccgccacccggatctgcacctccttcagccgccgaaccgaataggatacagccgccgcgatttcccggtcaccacagacaatggcctcaggcaggggtttgttgtaacgccttagataatccaggacaaattcgcttacatggtgcctgcattcccacggaagatgaagaaagggcacatcttcacctgtttctttcagacatgcctcttcacggcatgcgatgctgtatatatcccggcggtcccagcctgcataacggatgtcccggcagccctctttttgcagctcaccgcagagcgtacgcactgccttgccattatccagcgctacacagtccgcgaagggcagtcctttatctgtatcaaagaagaccatgttcatgcccagcgcacggaggcgtttcagcttttccatgtccaccggcagatcttccagccatatcaccgtgttctgaagcccccgtttataaaggcggtagagacagttctccagggtttccgtgcgcggcttctccacatacagaatcatggccccctcctgctccgcataggtctggatctgtgcgataaattcagcaaaaaacggattcttcgctggagctatcagtacgatcatatccatactgctggcggttccataattgtggaaacacaccctcgtcccgcttccaacttctctgacaatcagatgatcatgctccaacagatccagggacttcctaaccgttaccctgctcacctccaaagtctccgccagtatgcgttcggagggtatcctcttcccttcctgataggttccgttaaatatcaggtcacatattctgttttttacgttgatgtataaattttcttcactcatgcaaacaattatagtctttctgcattactgatgcaatagaggttactattaaaataaatctttatttctgggatacagttctttgtagatctgatatctttcctcatatactttctgattttccggatccggcgctgccacatcactgctgagccggacaatccagccgcatgcctcttcaaacgatgcataaccgcccgtgcccaccgcagccgtgatggcagcccccatacaagcctgttcctgaatcaggcttgtatagatttcttttccaaacatatccgcctggatctgacggaaaagacgacctcttgcaccgcccccggatgcaaggatacgctggaatccaacccccatatcctgaaagatttccaaagagtttttcagcccgaagataatcccttccattgtgctgcgtatcagatccgccttagtatggctcagtgtcaggccatggtagatgccttttgcttccggatcattgtagggcgtgcgctccccgctcagataggggagaaaaagaaggcccctgctcccggcgggaaccgtctcggccagggctgtcatatcatcgaaggactgcatatccagaatatttttcatcagccacttcaaagccacgcctccgctcagattggcgcccatgagcatccaccggtcttctcgtacatggcagaaggtgtttgttctgtaaagtttgtcatacagcggtgtgctgacagcacaggccagctggctggccgtcccaatattagccgacaaagttcccggtgatatgataccatttcccaccgcctgcatcaggctgtcgcctccgccatatacgagctttgtccctgccttcagccccgtcagcctctcgcacgcagcagttgactccccagccgcctcataggcttcacggcacggtacgaaaaagcctctctccagtcccagccggtctatgaaattccaagcccactgcctgctttttgtgtcaaaaatggcagtgctggaggcatcggacatatctgtgcccaattctccgcacattctgtaacgcagatagtccttgggcagcattaccttatcaatagaattgtagacttccggctcatgctctttcacccacatcagcgagctgattaaaaaaccggtactcagggaattcagcgagatttgatgatattcctcccttggtatgatggaatatagattctgaatctcctgctgcgagcgctgatcggcccatataatcgcatttctcaggggtttcccgtctctgccaatcataaccaggccgtgcatttgcccggaaaagcccacgcctttgatacaagcccttgcatcctgatgtttctccagcagtgacctgaccgtgcgcagggctgcatcgcagagcaggtctatatcctgctccgcgtactgctgttcccgttttataatttcatatcccacctgtgcggtccccaccgcccttccattttcctccataagaagagactttacactggaggttcccagatcgatccctatataatactgcatatgatcctcctttttataaactggttgactctagatccagacgtttaataatatcctcctggatatccggcgaaagatccaggaagttaacaaatgtaccgtggattctcataatatatacgccgctgggggcgtattttttgggattttccagcaccttgcgcagcatgccgggagttgttacattcacatacaagtaaaatggggatacgccctccttctgcggattatagaacaatggagatataatcttatcccggaattccctccctttctgctcaaacaactgggttttaaaataattcggattgatccccagatgggatgcatagccgccgttcattttatcgaaaggaagcttcatattagaaagcatcctgaatccaagcccctgatgcgcttccccatacagcggatccactccatatcccagctgttctctggacttcctgccgtccggcgtggctcctacccagtatccataaagcagatgtgtcgaaggagttgaccagtcaggccggaatggattgccaagataattctttttggatgcaatcaggtcgctgacacggttcgcgatctctgcggcctcgttatcgacccttgcgatattattaccgaatttaggcgctgtcagaagatactgctgcatctccggatcctgctcaaaattcgtgcgcagcgcttcaatcagccggtctgcatcctgggggcattcctccagcagggtgtcaatggcggtgaatgcatccgccacaactgacagaccgtgaatcagacagccgcttccgttgtaccttgttccctggcgcttcgtgtctctgacatctatcccgctctccactccgcccatcatagaagataagaatggaacctggagcaagccaatcgcctctgatgccgcattcgcacattccaccatcatatctgtatattcctccagattgctataaaatatggaacgaatattttcaagaatctcacgtttattcccatatcccagctcctcgtcgcttttaccgagcttcctgccggtgatcgtggagacacctccgttcagggaaagctccaatatcttgccgagattcagccagctgttcgttgtattgccattgtctttccccatgatcaaaggctcctggcagccggctaccgagtaatcctgcaggtcttcctcttccacaccgctctggttttttaggacacagaatactgcatcgtcgttaaacagcgatggggtcaggcatcccggagtgaagaaaaatctgcccatgctctcatatagttccgggggcgtattcttatgaagcttaacagagagaataggctgcggcagattcatatcgtagtaggcatccaggagtgcataagaggatggatttgtcaggtcctccccttcatttgatttaccgcctatcattagattctgagagatcgcccagcttctgtccgcaacattaaaaaacacaagcagatgcttgaataaagcggctgctgtctcccggtcagtcccgtccattgcccggtagggttcgaaaatccgatccgcatttcccacggaaaatgcaaaggggttcggtgtctgctccaggcacatggtctgccatattaaaataaaggactgaaccgcctcgtacagattctcagccccacgtccaggaacctttctcagagccgcttccatcatcgcaaaccttggcttatcctcctcccctgcactttcccattttttatgggcaagatccgcataccggcctgcaaggacgagagccgcatccagtgccgtattcattgcggtataataaatcttcttctcctcgtctgttacggatgccatctgctcccggatctgttccttaacgccatgtatccctttttttaacataggccgtacgtccggaatcagatgtcctgttacttgttcgataaaaaatatggcttcactcgtgctgtcgcccgctatatcataggcccggcgcagagcatctgcaaacttcgtgtgattgttatattcccttagatcctcaattctttctctggtgatatcaccaatgggatcgatatctccaaatacagctaccggatcacagtatccgctgaaagagtccactgtgaatgccggattgatcaatgcgtaggaacgcgcaaaggaatcatcctgagttcctgcaaacaggtgatagtcgctgatccacagcggaagttccctggcaatctccacaagtgttttggcaatgcggatggaatccggatcttccctgaattcactgtcacatcttctcatgatttcttttgccagaaaccacccttccagatggtctatgctccgttcctcctgaaatcttttttttgcaagttccgtaattttttctgccgtcaatacgttttctgccatcataatcgctgctcctttctctcttttcaaacacacttccatatgcaaatccatctatgtacgcatataattcaggccaagttccacgattttctccctgaacagctggattgtctcctctcttacgtgggccgtttctgacatcttgtattcccagccacactgttcccatttcttttttccaaactcatgataggacaagatctcaaacgtcacattatctcccccgatggtttgaaagaattcgagaaaatctctgatatcttcttcactgtcgttcactttaccgatcaggggaattcgtacgtgcaggcagggatggactctggcagcgtgccttatattctccagagtctgcttattagaaatgccggttgctattctgtgtttttcctcatcacacagcttacagtccatgatcagctggctgatatagggaagacattccttcaggcgcggactggcgccattcgtttccaacgctgtatgaatctccgctgcatgcaggcgttccagagtctccagcagttcatcaaactgtagcgttgcctctcctccggtaaatgtaaccccgcctccatcataaaacatagggctgttcgctgtaacttcttctacgactgcctccacctccacctcttcataggaaaggcgtattcccttcgtccgatgcttagtcacgcattctttttccatgcattcccggcaaatcgtcctgtccagcgtcttatttcgaactgcatgatgtggacagacctcatccaatagccattcttcctctgttattagtacgccttcccatctcattccttcgggattcgaacaccaggggcaattcatattgcacccttgtaaatgatagaccagcctatttccaaatccatcctgggaatagttaaaccctctctgaaatatccgcatggcattgtcctttcctttctgtgagaaatagttccccttctaattggtattgtataataataccaattagaagtcaacataaaatacgcctaagaagattataaaatcaaaagcgtgattgaaaattgcttgccgcaggctgtttcaatcacgctctcatacatcttaaaataagtccgcagcttctacggcatgcaggatttcctcgatctccccagttccgacaacaagggccatcctgacgtatccttccccctcgcttccaaatgcgctgcccggcgttacaatcagccctgttcgttccatcagttccatacagaatgcaaatgaagactcatatttttccggtatcctggcccagacaaacatcgttcccgcgctgtccgggacatcccagccgatccgtctcaatccggcgcacagcgccctgttcctcctctcatattccaagcgctgctcttcgataaaatcatccggtccggtcagtgcggcgatagccgcatactgcacaggcaggaatatcccataatcaatctgtgaacgcagcgtcttaaacttctctacaatctcccggttccccaccacaaacgaaattctggctcctgtgagattataggactttgacagagagtaaaactctacggcaacctccctggccccttcaaaggaaaggaaggaccgcccctgtttccgggtataaataatatccgaataggcattatcgtgcagaataatgatttgatgttttctggcaaacacaatcagcttttcataaaattcatccggcgcacaggcacagaccggattgagcgggtaggaaacaaccatgtatttcgttcttttcagcacatcctccggaattttctccaaatccggcagatacccgttccgctcttctatcttataagtctcaacagctgcccccgccatgataccgctcatctcaaacagaggataccccggattcggtaccaggattgattcccccggattacaaaggaccaggccaatatgggccatgccttcctgcgacccatagaccgacatcacctcatctggctcaagtttcaccccgaaccttttctcatacctgtactgtaccgcctcaatcagctccggcagatcggtaagtgagtatttataattctccggatctttgcaggcatcctgcatcgccttcatgatatgcggggccggtttaaaatcaggggtaccgaccgacaaattatataccctgcgcccacgggcaagcagctcattcttcttctgattcagcgcggaaaagattccgggttgaatactattaactttttctgaaaattgaaaactttccattctttgtgcctcctcttttgcaatacaggtattatatcatgcatttcaggatatgtgaatgcacttgccgcagctggcgcgaatgccaatacattcgcgccgcctgcggcaacgggatttgaattatttgaattttagccaggtatttccgatcatttcataaaacgcttcttatcctccggtgtcattatgtactgtacaatatcctgcacatcacattccaaaatcgtgcacaaatcatttagtgtgactgtgctgatcggtgcattttttctcaatctgtctattgtagaaccggatactttgtaatcttttattaatgtataggtggattcgtccgaattttgaagagtcatccagaaaggactgtagtcaatcatatcaatctctccttttttataggatagtatgcggttctttaattgactatagtctataaagcgactataataagtacaaaggagggattcgttttgttgcacaatatgaattatgaacaaaaaaagaaattctggaactttgtgtatatggatgatatcgattttttttatgagtttatcgcagatctgtctgatgatgaacagattagattttttgaagaaacacctgattttctgagtgataatttaaataacaacgagaccaccgatctggaagaggatgcaatctatcagcgcattatgaagaaaatcagtcagctttaggaatcagaccggtgaacagatcagggggaatattactccaaaatgcagacagcaaagtgggcaagcccgcctcaacgccccaccccactcatgaggggcttgtacactttggcgccgcgatgccgcttgcggctctgtaccttatcgcggcgagtgcatcctcccggagggttttatgatataggaaattccagaggattttcctatatcataaaacaggggttcggcttttataaccgaccccctgttttcacctttggttaagcagtctgctgctctgtatgttcttcctgccccaccagattatatatatcctgaatggacatattatttgttgtcataaaatcgtaaagttctttcagctcctcgtctctcttcttattcaatagctctttcttttgctgtactaatgcatccagcttttcctgcagtttattaatctgctcgtccaaattacgaatttgtgtttccagtgattttctctgtcttgccattatacttctctcctatcatcaaatcttgtaatttaatagtactatattaaagtatatgtacaagcttgataattattccaaaatattccatatctgtctaaataattcttttatttaccatcctttatgcttccgcaacggtagattgcaattttaacgcaggctggtccagtcatttcatttagtacagaagatgacagtgtgattgtttttatatgcagcaatgacttttagaaacactattcgaatgcggttatgactgataaaagcactgggagaacacttaatgatctttatcatgcaacgacctggtattctgcagttttctgcgttccattcgtcttttacggagttttttcctctgaagtaaaacataatagaaacggaggcaccctagtaacaggagaatcataataatgagaagcagaacttttattactatagtagaccatgaacccgcactcccggaaaaaatcggggcagcttcatatgaaacggcaggagtttgataaccgggcagaaattctctttttaaatttacagatactttcccgttgtccagattaaatgaaacatcagtattttgggggacacagtcccacaggtcttttttaatctcaattttcttatcattaatcgtgtggatacctttttttagtactttccggtactcaaaattttggaaggcctgttccataatggcattgccaatgacatggcgtatttcctcacctgcctgatcctcccactttgaaacacccattacaatctctacaagacgggtgtttccgcgcagtgcagtggaagaataattaaaaccgttttgattggaaccggtctttaatccatcggttcctttcagcgaatatttggctccttcgatcgaatactggtaagtatcaaatttctcttcgtacggagttccttcttttaccacgatcttagggtattttgtatgatttaggatatccggataagttttcacaaaatagcagcatagcagggcataatcctccggtgttgtgacattcacatccgtaagtgaggcattgacaggctggtagggaatcagcagtttgttaggaactcccacagggttataataccgggtattcttcataccaatggatgcagctctttcgttcagaagtgtaacgaacttgtccgggtctggctcaatcagatctgcaagcatataggttgcggcagctgaagatgggacaatgatcagatcgaataattctgctacagtataggtagctccggccagcatcttgttgttgctcaatgaatacctgctggctatatccagatatttgtcagtgacagaaacctgggtgttcagcgagaatttgccttcctgaatggcatcgtaagccagcagtatggtcataagtttagacatgctggctggctcccaggatatctgcggattttcctgccacaggacttgacctgtatttatttctacaataatagaaccagcaggctgatagcgctcttccagttgattaccgttactccgggcaatatcaatggcccgttctgccctgacttccattccgggaagcaaaaaagataaacatagtgaaaaggcaaaaacaagaatagcatataaaaatagatgcttttgtgttttcatagatgtgaatcctttctcaaaattgtattgtgatatagtgtgtgcccgaaagttgcagactatatcatacccaaagggcatgaattacggggtccctttgggtatacccttcctacaatatatgataagattttgatatgcccgcggaattgctgccgtttcagaactacatgaattctcaatccccccttaaccacgcggtttctctatattctcaaaaggtgttccatacaggtcgtaaggagtcagctgatagacgtaataattgagccagttcgaataaagattgtttgcatgagaacgccagagcagttcgggcttattgcccggatcgttgtttggataatagttcacaggcacttttatatccagccccttggctttatccctcttatactccgcatccagcgtcactctgtcgtattcaggatgccccattacaaaaatctggcgtccttcctttgccatgcagagaaatacaccggcctcctccgattctgccagaatcgtaattcggtcatctttctccagcagctcgcgtggaactgtcgtatgtctggaatgcggtgcaaagaacacatcatcgaaccctctgaggagaggaatcttacggttcctgacatggtgcgggaatatgccgaacatcttttcaggaagctgcactttattaatcccataatgataatagagtcccgcctgggctccccagcaaagatgaagcgtagacgtaacattggtcatggtccagtccatgatctccttcaactcttcccaataatccacctcctcaaaaggcatctgctccaccggtgcgcctgttatgataaaaccgtcaaacttctggcttttgatcgtctcgaaagcctcataaaacttataaatatggctggtggacgtgtttttggacacatggctgcttacccgcacaaaagtcacgtctacctgaagaggtgtattggagagtgaccgcaggatctgaagttccgtatcctctttaagcggcatcaggttcagaaggccgatactgattgggcggatatcctggtgcgccgcacgggattcgtccatcacgaatatattttcctgctctaaaatctctttaaccggcaaatcattttgtactcgtattggcatattttattcccctttttctttatttgtttcattatcgtctgaatgtacataagtcccgtcagcgtctacatagctcatttctccgtacgctgcggtatcaatcggcagtttcttcttctcaagcatatggttaatcagcatatttataatatagtagattaccgcaaaagtaggcacgcccaaaatcatgccgataaccccaaacagccctcctcccagcaggattgcgaatacgacccagaacgcggataaccctgtggaatcgcccagtattttcgggccgattacatttccgtccaattgctgcagaaccagtataaatagaataaaataaatccccatctttggatctgtgagcatgatcagtactgcactcggtattgctccgatataaggcccaaaaaacggaatcacattcgtcactccaacaatcacgctgacaagaagcgtatatggcatcttcaatatggaaagcccaacaaagcaaaggactccaatgattgccgagtcaataatcttaccaataataaatcccccgaatatctcattgctcttgatggtcagatgcagaagcatatttgcctgagagggttttaaaactgcatagaccagtttttttgattgtcttgcaaacttttctttgctgaacaatacgtaaatggatatgatgattccgatgaccagattcagaagttcgctgacaatattgatgactcctaccgtcagattcgacataacaacattaatctgattcaggaggtcggtgcgcatccatgtctgtataaagtccgtagcttcctttaagacattgctcaaaagctggccgagtgtggaatcctgtgaattcatctccataaccttgtccaccagctggttcagctggcttggtaccgtgagaatcatatccctgatgcttccatataattccggtatcatcatattaaataatgcgacaataataaacaacagcaccagaaccgccgcaaagatccctgcgcctctcgaaagcgcatgaatccgtctctgatcatgtaatttcttttccagaaaaggttttaaatgtctctcaacaaatttgacgatcggattcagaagatatgcaattgcaagcccataaacaattggctttaagactctgaatatttcttttaggacttctgaaattgcgggcagccttaacagcgcaaaataaaagaggatacaggcagcgatcactacaaaaatagtcatgccccggctgaacttctgcctcagttttgatggtccgttttgtccgaaagaagggcgttttgcataatatccgctgctttcttctgtttttttatacacctgattctgtttttcttcactcattcacatcagagtccttccaatttttatgcagatattatgattataacgcctagcaggtactcaagtcaaccaagaagagcaggtatgccggtttctaacccggatacctgctcttcctgcttcactttttccaagtgcggagtttaattttctcaacctttacatttaaatgtggcacattctgtaccctcgcaatgacaggcattgcttccttctacactgatctttcctgcgtggcattcacagttacagttatacatacattctactgccttacagtcgatacagctgcagtctgaagccttaccatttacatcgctgtagctgtttgaatagctgttggaataactgttagaagagctgtcattctttctttcctggaaactgtcgcagcatgtctctctgggagtttttgcgttgcttcctcctacctcgattttgtcaaggtcacataaaaactgcttattgtgcacacatgtctgcacggtacattttaattctggcatgatcatacctccttcttattaataaaatcagtatcattatgccctgccgccctttggattattcctgttttactacctcacggactgtcttttcggcaatttcactggaaacagaagcaacaaattcatccaagctcttctgaccctcgtcgccggcaaatctgcttctcacagatacaagcccattctcttcttcctttgcgcctgccacaagcatataggggattttctgcatctgggcttcccggattttataaccaattttttcggcccgggtatccatttcagttcggatcccggatttattcagaacttcaaatacttttctgccataatccatatatttgtcggatatcggaagtacccgaacctgaaccggagccagccatgtcggaaatgcgcccgcgaaatgttcaataagaatcccaataaaccgttctatggagccaaatgcaacgcggtggatcataatcggcctgtgcttttcgccgtcagcgccggtatactccaggttaaagcggagcggcagctgaaaatcaagctgaatggttccacactgccatgtccttcctatggagtcctccaggtggaagtcgatctttggtccataaaacgcaccatcgccctcgttcaccacataggaaagaccaagatcatccagcgcgcccctgagcgcatctgttgccatgtcccagtcttcatcgcttcccatgctgtcttccggacgtgtagatagttccacatggtacttaaacccgaacagactgtatacttcgtcgattagcctggcaacatctttaatctcatcacgtatctgttccggcatcataaagatatgagcatcgtcctgggtaaaacaccgtaccctcatcagaccatggagctgtccggacttttcgtgccggtgaaccagacccagctctcccatcctcatgggcagatcacgataagaccgcggctccgactgatagaccagtatacctcccgggcagttcatcggtttgatcgcaaaatcttcttcatcgatcaccgttgcgtacatattatccttgtaatgatcccaatggccggaagtctcccaaagatgacggctgagcatgatcggggtggatatctccacatagccgttcctttgatgtatctcgcgccagtaatccagaagcgtattctttaaaaccattccttttggaaggaaaaacggaaaaccagggccttcatccctcatcataaaaaggccaagttcttttcccagctttctgtggtcacgcttcttcgcctcctccagcatggccagatactcatccagctctgcctttttcggaaatgcagtcccgtagatccgctgcagcatcttattcttttcgctgccccgccagtaagctccggccaggcttgtcagcttaaaagcttttaccggttttgtcgtcatcagatgcggccctgcacataagtctgtaaactcgccctgtgaataaaaactgatcacagcatcatccggaagatcttcaattaattctactttatatggttctcccttttctctaaaatatgcgattgcttctgccctcggttttgtaaattgttcgataggcagcgcttctttcacaatttttttcatttccgcttcgattttatcaagatcatccgctgtgagcggtgtttcacggtcaatatcataataaaaaccgtctgccacggaaggtccgattgccagctttgtatccggatataatcttttaacggcctgtgccataatgtgtgaagcggtgtgccaaaatgcactttttcccttctcatcctgaaacgtgagaatattcagatcacagtcactgtcaaccacagtccgcaggtctgctgtttctccgtttatttctccggctgttgctatgcgtgcaagcccttcactgatatcagaggctattgcgatcacggacttgctgcccgcgtattctctctctgaaccgtcttttaaagaaatcttcattttcttttcctcctaatacattatttaaaattttttattatagaatataaaaaatccctttccacagaaaactgcagaaagggacgagtctataaagttctcgcggttccaccctatttgtgctggtatactgataccagaaccactttattcatgatgataacggaatcaccggactgttttcagccactcggaggtagttttcaaatgcttccgaaacagggagttttcagccttggctcccctctctggcgctcttccacactctactcgtctcgtctgcgtgttattattatgtttccatccacgtcaggtaatttcacaaagtacgactacaatgtctgtgggagataccaattcctctccgcccgccattgccgttaatcttgtttttcgtgattcacctctcccctatagaggtgggcttatcttgttgaatctaaactcattataacatcacggttatttttgtcaaccatattttctatatctaatccggccgtatttccagcaattttcgggtgcctgattttcatgaatgctccgaatagcagccttgtcagcggtcctgctgcaaacagattccaaagcagtgccatgggaaaattcttcagcagtgtccctgcccagatggccggcagctggctcacgggtgcatgccccaggataatattaaacagtatggatgccgccaaactcatggtaggacacataatcaaaactgtacatccggacatcataagtgtcatataaaatggattatcgatttcaggacgaacgatttttccggcgagcttgcgtccaactctgtttccccacagatttgaaaagataaacacaaggatccacatatacgaaacttctataagcgcctccagaaaaacgtgatttgtcatattgctgaaactgcctgccattgtatgatacccctgtttaattgcaacattgtatacttccataccataagccatggttatggacatgaatgccccatatagaatccgctgaaattttgtttttggcataataagccctccttctcatatttcttgtcctgcattattctgcagatataagaaaaaggcgtataatctttgaatttacactcatagactacgccttaaagacttatttctattggtatcatatgccatatatacgaatatggggattatggcctttttcttcattccatttctattttaacagatttttttattttgtcaaagcactgttttaattttttattgttttggatccaatgctttttatgttactgccgtatctttatccagagaactgcaaaaaattccctcacaagataattcagcagcagaaccggatttgagcctgctgcgattcccttaaggtttgtgaaacctgcctttttcccaatcaacagcgcgcggtacagatggaaattattagtcacaactgcagccggctgttccagatctccaatcatcctgccgctatttttcatgttttcccaggtggatgtggaactgtcctcctgagaaattctgttcctgtcaatcccctgctgttccagatacacggccattgcctccgcttctgttatgtcctcgcctttcccctgccctccggatacaactgcctttgtctccggatactgctccaggtaaaccaatgcagcgtccagtctgcgtttcagggaatttgtaatttgggttcctcttacctgtgctccaagaatgataatacagggcacctcttctttggtccttctcagcatggccctgcagatccaggcctccgtatagagaaagacagcccagcagatcagcacaatgacggacaaaagctgtccggcggttcctcccggatcaagataggccagtagcaggtgcagcgccccggcagcaggccagaacagagaaaaggttgaggcccattttcttgtgtacagatacatcaccagataatacatgatgcaaaaaactccggttatcaaataataaattctcattaagttctcccagttataatcagatattcaaaaatcctccggcttccgtgcccagaggatttcttttacaatatactgccgaagtatgccgccccgcttcatagtctaggcgttcttaccacagcactttttatatttcttgccactgccgcatggacatggatcatttcttccaatcttcttttccttacggacagttcctgactgtttctgttcgcggaacagacgcttttttgactcctcatcaaagatcttgtcccactggggaagctcgtacagccactctgcctttgcatccaccatgttcttgtataacttttccttatcaaaagccaagctgacttctgttgtttctgtcatcgtctcaatcggattcggtaccttcaggctgtcattgatgccgtccaaaaatccaaccatcgtcataacgtcctgtccatattttgcagccagctcttctacggttccctttacttcctcatccggtgtctccagaagttgttcataaattcccttttcaatatcaaaatagccgccccagaactcttccagctggttttttgtcagctccttgttataggctatatcccgccattgatccagtaaacttttttcactcattgtatataactccttttttcaaaatttcgctcgtgtccccattatataacaaaatttacggttagtaaagaatttatggtcaatcctctactacaggatttcaattatgtaatagttcgggcaggccagaactgttccccaattgccccctatacagtaaaaacaaaatacgggacattccgggcagatacgcctgcctggacatcccgtttcacatttcacattgatgcttttcacaaaaagcaccaactgccgaaatcttatttgaaatacgtctttgtttcgcttataataaaactatcttattatgtatgatagaaaggatttataatgaaaaaatcgaaacgtattttagcactgatcggtgccgttcttctcctatgtctgtatggcagtactttgatttttgcttttgttgaccgttccgcatcctcgggcctgctgaaagcttccattgctgctacgatattactgcctgttctgctgtatgcctacactttagtttatcgtttatcccaaaagaaaaaaccggatgactcagatgaggatcaatagccctctacacgaataatgttgcaatttccagggcagcgctccattctgctgctcttcttttttgtggttctttcatgaattctgttcttcttttttcttgtcttctctccaggtattcttccatcgaaattatctcttgagttctttcattgttgctctgacgcataaaaatacctccttttcttataagcctcagccttattattatatgtatactcacccgtaaatatgccaaataatgtaatccaggggcttgcttcagaacgaatttctgcggctgctttaccggtatacatcaccccttttggcatatgtatattctactgtgtaaatgtgacagagttatggcagaaatataaagattttattatctaattcttataagaaattgtacaactatgcagttaattttcgatataacggtcttctgcggaatctgcctgactagaacaaagtgggcaagcccacctcaactccccccctcactcatgaggggcttgcacgctttggcgccgccgcgatgccgctttgcggctatataccttatcgcagcgtgtgcatcccccggagggtttttatgatataggaaattccagaggaattacctatatcataaaatacagcaggattttaaaaaataaaatcctgctgcactgctactctgatattatattacggtaaatgatgtcttctctgcccggcccattgctgatcagagtgatcggatagccaatctctttctcaataaactcaatataatttcggcaattttccggaagttcttcatataacttaattccgcggatatccgttttccatcccggcagtgtcttaagcaccggttttgccttttcaagcagatgggttaccggaaaatcttttgtaacctcaccgttgatctcgtaccccacacagactggaatctcatccagatagcccaggacatccagtacggtaaaggccacatctgttgttccctgcagcctgcagccatatttggaggcaacacagtcgaaccagcccatacgtctcggacgtcctgtggttgcaccgtattcaccgccgtcaccgccgcgccgtctcagctcatctgcctcatctccaaaaatctcgctgacaaatgcccccgctccgactgcgctggaataagccttacataccgtgataatctgtttgatctcatagggcggaatacctgcccctatggcgccaaacgccgccagcgtggaagaggaagtaaccattgggtagatgccgtggtcaggatctttgagtgatcccagctgtccttccagcagtatatttttcccatctttcatagcgttgtaaagatacagagagacatcgcacacataaggctcaatcatctctttatattctttcagttccttatatatatcagcaggattgatctgtggtttgtggtataagtgctccagcagaacattcttttgttccgccacacgctcaaccttctctctgagcagttcatcatcaaacaactcacttacctgaaagccgattttagcatatttgtcagaataaaacggcgcaatccccgactttgtggagccaaacgatttcccgccaagcctctcctcctcatatgaatcgaagtttttgtgataggacataataatctgtgctctgtcggagacaagaatcttaggcttcggaaccccctggtctacaattgactggatttccttaaacagtactggaatatccagtgccacaccattgccgatgatactggttgtatggttataaaatactccggatggcagcgtatgcagtgcaaatttcccataatcatttatgatcgtatggcctgcatttgctcctccctgaaaacggacaatgatatcggattcttttccaagcatgtctgtaatcttgccttttccttcatcaccccagttagcacctactactgcttttaccatgtcaaaccctcctgtgtgtattattacttataagttaccattagcagttcttataaatgaaccacctaatgaattatactatatttttcccaatatgtaaattattattttacaaaaaaggacagctccatttgcataggagtctgtccctttttgttcaggtaatgctttacattagtggcgcaatcagccggagtactcttccgcaaatggccataagcgggctgatctttttcaagtccgctatggaaattctctggcatttttccagagttttctgaaaatctgactctatctctctgacaaccggattgttgtaaataaagacgccgcattcaaaatgcagatacaggctccggtaatccaggttgatggtccccacggttgccgtgtcattatctgagacaaatatctttgcatgtacaaaaccgggagtaaattcatagatttgaacgcctgcttctatcaattcccggtaatacgtcttggcaactgcaaaggcataccatttgtcaggaatatgcggcataattatgcatacctcaatcccgctcttggccgctcttgtcaatgtatcgagcatttcattgtccagaatcaggtatggggtcataatatggacgtattttttagcatgattcagaatatggaaatagacttcttcccccacatcttcgttgtcatagggactgtctccgtatggaatcatgaagccaagttcgcggtgcagttcggccgacatgggtgttacatagcgtttatactgatccggctttagttcggtcacattccacatctgaagaaacagcatggtcaggctctgcactgcatccccctccagcatgaccgcagtgtccttccaatacccgaaacgcactttccggttgatatactcatctcccagatttatgcctcctgtaaaaccaatttttccatctataacacatatcttccggtgatccctgttattctgcgtggtagacagcaccggacgtatggggctgaacatcttgcattggataccatactttcttatcgttttaggataattatagggaagaagggaaatgctgcacattccgtcatacatgaaacgtacttctacgccctcctgcactttgcgcttcagaatatcgagtatagaatcccacatatatccctcttctacaataaagtattccaaaaagatgaatttttccgccttctccagacgctctaataaaacagtaaacttttcttccccgcatgcaaaataagttgcctttgtatttctgtatgtaggaaacccaagctggtgcttcatgtagtgtgccagattcgcgttggcaggcttgctcagacgcagatcgtctatgatctcctgtttttgttccatatactgccacgtatccagtttcagcctgccgaggcgttttccaatatatctggtacccagctgggacttgacataaagatagaacaggcatccgaataccggaaaaatcaggatcaaaagcacccaggtcatattgaatgccggattacctctctggttgataatatatataacaatcacggcgcccagaatattcatggcgctgtatacatatacaacataatctcttagatacgttgctatcccaagcatcagtaaaaattgtaccactacgagcagcaggatcaacgccgtcctgctgaatacaatactgagcgcacctttcttcgccttttctgcagttttattttccataatccctcacacactcctcaattagcttatactttaacagtttaacacattctgcagacaaatagtaacctgcagtttatttttgagcacaattttgagtacattgttgtaattgcgtccaaaaagtattacaatagaaaatgagtttagttattatcccatagaaaggagacttatacattgaaaaagtttttaaaatggttcataagtcttgcagctattggttctgcaattggccttatcatagcttatttctgtaagggcagatgctgtgacgatagctgtgatgacagccaggatgatacagaagaggatgattttgacttggacagcgatctggagcccgttcctgacagggaatatgttccgctgaacagaacatctgatgctgcttccgacaataaatcggaaggaactgacaaggaagaaaaaggatctgccgaagctcctgtcgaagaaaaaaaatagatttaatatctcacggaacctggactattgtcgcaggttctttttctatttccatgcctcatccagtatcctgaccgcttcctgtatcttttcctcattcatattggcatagcccagcaggatggtcgcctgttttcccacctgcggttctatataatattccgtcagcccgtaaaccctgacgcccttttgagctgcccgagctgtcagctcatcttctgccatatgattatgaaaatgaagcagaaggtgcacgccggcattttccccggagattacacagcggtcctggaggcttttcaggcatcctaaaagcgtgtcatgtctgctcttatacaaggcccttgttttattcagatgccgctcgtaataaccctcttcgataaatttttgaagaatgagctgatctaccttggaaacggtagaatttaaaaaactgcttttttcctgatacaggaccaggagggatttgggaagcaccatgtagctcattcggattgcgggtgcaatggatttagaaaaggtgcccatatatattaccttatcacagctgtcatatccctgcagcgccgggatcggcttacctttatagcggaattcactgtcataatcgtcctctatgatatagcgcccctcctgctcattcgcccatttcagaagtgccagccttcgtttgatcggcatgacgattccaaggggatactgatgggaaggcatgacaaaagcaatgtccgcgttagattccgtcaattttgtgatgtccattcccctggaatccatgtcgactgtacagacctcataggaaagatttttaaacaaccggtatgcctgcttataagtgggattttccagcgccaccttgtgttcatggccaatgaccgtcgtgagaagcataagcagatagtcatttcctgctcctacgataatctgctccggctggcagttcacgccccttgcctgatgcagatagtcacagattgcttcccgaaggccatattccccctgcggctcaccaagacggaacatctccgcccggtcatccatcaggcagtccctggacagcttcctccaggcattataaggaaagctgttcagatcaacgccgtttggggtaaagtcatacgaataccgcttttcttcacgtacggatcctcccgggatcctctttgggctctgcttcaactgatataattcctcaatctgcgccacaaaaaagccccggtacggttccgattccacatacccttctgagagaagctgttcgtatgccagttctaccgtgctccggcttacttccagataacggctcagggaacgggtggacggaagcttttccccgctttggatccggccgctctggatgtctttttttatatagctgtaaatctgctcgtacagcggtatattcgatttactctgaagatttattgttaattcgttcatatcacgcctccaacaccggggcttcccggaaatcccaattgccaaagggacaggtctgatgaatagacctgccccttacctgtttattttggtaatctaaaagaacttttcagtgaaactatacgattgaagactagagcttccggcttggaatcttttgcatctatgcagtaatacccgtttctgacaaactggaagctgtcataaggtgcagcatcttcaaaacttggttctacaaaacagtttttcacgatagtgagagaattcggattcagattcagtgaaccatcttccttattataaacgcccttttcctcgtctaccagattctcatataacctcacttcggctttcacggcatagggagccggaacccagtggatcgtgcccttgaccttcctgcctgtgaagccgcttccgcattttgtctccgggtcataggtgcagtgaatttccgtaatatttccgttttcatcctttacaaaactctcgcattttacaaaataagcgtgcatcaagcggacttcattgcccgggaacagccggaaatacttcttaggaggttcctccataaagtcatctctttcaatataaagctctctgcagaagggaaccttcctgcttccaagctcctcgttttccaaattatttgccacgtccaggtattcaacctgtccttccgggtaattgtcgatgatcagcttaatcggatccagcacagccatcatacgcggccttttcatctttagatcctcacggatacagtattccagcatcgcataatccacagaactctggctcttggataccccgcacatatcaatgaacatcttaagggactccggtgtaaatcctcttctgcgcagagctgcgattgacacaagacgcggatcatcccagccatctactatgccgtcctccacaagcttcttaatataccgcttaccggtcaccacatttgtaaggtacagctttgcaaactcaatctgtctcgggggctgttcaaactcacattcctttaccacccattcatagagcgggcggtgatcttcaaactccaatgtacagatagaatgtgtgattccctcgatcgcatcttccagaggatgcgcaaaatcgtacatcggataaatacaccatttatctcctgtattatgatggctcatacgggcaacacggtaaataatcgggtctctcatatttatattcggtgatgccatatcgatctttgcacgaaggaccttctccccatccgcatacatgccgtccttcatattctggaaaagttccagattctcctccaccgtacggttccggtaaggactttccttaccgggttcggtcagggttcccctgtattcgcggatctcttccggcgtcaggtcacagacataagcctttccttttttaatcagctttaccgcatactcgtacatctgttcaaaataatcggatgcaaaatacagatgatccttccagtctgcccccagccacttaatatcttccttgatagaatccacaaattcgaccttctcctttgtagggtttgtgtcgtcaaagcgcatattgaactgtccgccatattcctgcgccagtccgtaatttaaaagaatagacttggcatgtccgatatgcaggtaaccgtttggctccggcgggaatctcgtacagacatggtcatacacaccctcggccagatccttgtctatctcctgctcaataaaattctttgaaactgtctcgttttccatagtttcctcctcaagtagtaacattctgccaattatcttaccataaaatgtataccgcgacaaggactgccgcccaatattttcatttcactttcaatgaaaatatgatatactgttatggtttaaagcgaaaaaggagtgcaagggggtcagacccctctgcagaggggtctgacccccttgcactcctttttcagataatttgggaggttgtttatgaaaagagaaaaatttgggtcccgtcttggttttattctcgtatcggctggatgcgccatcggactggggaacgtatggaaattcccgtacatgtccggtaagtttgggggagcggcattcattctgatctatctgatattcctggcgatcctgggtcttcctattatagtgtgtgaattcagtgttggaagagccagccagaagagcatcgccacttcctataatgccctggaaccggacggcacaaggtggcattttacccgctggttcgcgatcgccggcaattacatacttgtcatgttttactctatggtgggcggctggatgctctactactgcttccgtatggccagaggtgatttttccggtatcgtatcggaacaggtgactgccaactatgaccaaatgctcgcgtctccgggaactttgatgctctggaccgtaattgtcatactgattgctttcggaatctgcagtatcggacttcaaaagggcgtggaaaagattatgaaggtaaccatgatctgcctgctggctatcatggtcgttctcgcagtccgttctgttactctgagcggttccagcgaaggccttcgcttctatctggtgcctgattttcataaaatggtggaaaatggaatcggaaatgttattttcggtgccatgagccaggcattcttcacgctaagtatcggaatgggcgggatggctatcttcggcagctacctggacaagtcccgttctctgacaggggaatcgctgagtatcgtaatcctggacacttttgtagctctgatggccgggctcatcgtcataccggcctgctttgcgttcaatgtagagccagccgcaggtcccggacttgttttcatcacgctgcccaatatctttacacagatggcaggaggcaggatttggggatccctgttcttcctgtttctgttttgtgctgcactctctacgattgtgggcgtttttgaaaatatcgtgtcctttggaatggatctgtttcatttcagcaggaaaaaatctgtcgggatcaatatcctgctgattgccgccttaagcattccatgtatccttggattcagcgtatggtccggcttccagcctcttggaaccggaacaaacatcatggatttggaagacttccttgtatcaaacaatatcctgccgctgggttccgttgtctatctgctcttctgcacccataaaaacggctggggatggaaaaacttcattcaggaggccaacagcggccagggaatgaagtttcctgaaaaagtccggggctacatgacctacgtccttccctggatcgtagtcattatatacctgaaaggctattatgatatgttcagtaaacaaagcacggctatctttgtgatatggatgattatagcggtagcgttcctcgcaatgatactgtttgttacgggtaaaaggaagaaaaaggggaacgccaggtaaaagggcgcggcatattgacagtgccagcaccgtttatcctgcgcatagttacttcttcagcctcccacgcagaatcgtcatggcctgggccacgattcctgcgtggtccactgcgatcatcccctgctcggagactgtaaaatgctcttctctgatcaggccccgcctcagcgtgtgttctaccacggccctagtatcaagacacttctctttattcacaaaatgcagaatataggtccttctgactgcttctttttcattgctctctgctgccagttccatctccacgttacaccaggccgcatcggccgcgtcatctccggcctttatattgacgtctttttcatccaccatcgccatgtaggctgtcgttatgactctggtgcgcggatccctgttatagtccccaaacgtagcaaactgctccatgacaggatttttcagaccggtctcctccataagctctcttttcgccgtatcctccagatcttccttcatctctataaaacctccgggcagtgcccagaaaccaatgctgggatggttgctgcgcttcaccatcaggatcttaagcccctcgagggtttccgacagcgctccgtcgtgagaaaatacaaccgcatccgtcgtacagcttggtttttcatatttataaggatcatagtcctccagaaagtcctccagcgtctgtcccgccggatttttatcatgagtcccgtaaaatggtgtgatatcttccaaaaatgtttgcatctgtttctcctcctgctgtataatacccaatactgtgtttgatatttcaggtaaactactccgagttataatagaaagacggaacgaggatgttcccccgtcccgtctttccattatattagattttatgtcttctgtaaacagctgcttttataattaaaattctgcaggcttcctactcgctgattctaacgtacggtgttgtaatcgcactaccgtccgcattcgtaccacctgcaaatatccgaagatacagattatccagctggtcttcgtctgcaacatagaccagggtgtattctatctcttctcctgctgacatagggcggaaaaatgcagatttcattctttcgatcccttccgtataatatatatcatcgtaatagatcgggaaactgctgccattattggaaagccactgcatgccatacccttcatttgctgatctgaaactgtccgctggataagcacagctgccgtcttctcttggtatcagtgttgtcagatccggggcaattgagatgcccattatctgattgctctctgactgcacatcggaataatttttcgctttcatcttaacaacaacatacttggacttcacggtttcaagcacgccgtcctgtgattccgtgccatcctcatctaccgtataccgatatctctcatgaggtttcagagtaccgtcttcttccatccacggagcaacttcatcataactggcaaagttctctgccgggtattctgacagtggaagtgcgtccagaatttccgcatcctgcacggtaaaacggacatcatccgtgccatctatctgctgaccgtcctccatcattatattaggatcactgatttcatctcctattgcatagatgtcatcggctgccactcctgtctgataagactttgcacaaccctttgcataagcttccatatcctgaagttctgcatctgtcatatagggaacggtctcttccaggacctcaatcttcagtccttctgcgacttttactatttcctctgccggaaggtcgctttcactccataccattattccgtatccatactcttcattgaatagataaatacgcttaaccgtctcttcgctgtctgtgtaaaaactgtcattcacaaatacatccgtcttcattccgctgatttccagcgtgtccaagtgggagtcctttgaataagacatgacgtctacggcaccggtacgctctaagtaatccagatccgctgcattatatgggataacagaaagggctcctccatttgcctcattatgccacttatttccatatgggctgtcttctccgtacaatgtatacccttcaggtatataagtcgcttccacagatatcttatgggcttctttttctctgtccacttgaaaatcatatttaacagagttctcattctccacaagatttgcagaaaggaatttacttgccgccagcgtgacaacagacattcccactgccagcaccgccactgccgccaccgctgcccatgtacgccgcttccttgtatacttcatcgctacctttttcccaatccccagctgctcataagtatcctgaatccgattctctattttctctgggatttcaacatcctgttgtaaaattcgttctattttcttttttgaatattcgttcttcaacacttctacctcctttgaactgccacttccagcccatatactctttcaaactgcctgcgtccccggaccagccttgtcttgaccgtactctcttccagttccagtatctgtgcaatttctctgatcttgaaaccttccgaataatacaaaagcaaaacgatccgatacttgtcgtccatctggttcatcagttcttcaaattcataattctgaagcgccatacatgtaccctcctgttccggaacagtatttgagagatattcccgttttccggctctcaaaatgtcgttgcatttgttgatcagaatacgtatcagccatgttttaaaatacttgggttctttcagcctgtcgatattctcatagcatgtaatgatcgtttcctgtatggcatctgcaatgtcttcctgtttatgcaggtagcttcttgcagtcttgtacatatcctgctttaccagttcgatcagttccacaaaagcctgatcgtcgtgcttctgtgctcttttaataaggtatttcaacagaagacctccttcccctcatcaatgccggcatgattatctttcacttattagacgtaccgggacagcaaaaagtttcagactgctgataaaaatttataaataggaaacaaataatttctgaaatttatcgtaatattacgaaacaacattaacatttcgattatcttccaatgtttgcctgttagtattcatgttattctataaaaaaggggggtgccgttatgaacgataaattagaaagcctgttcagtgcacattatggagataaaaattttctgaacagaaactgtcagcattattactgcgatgtcctatcgattgcttcagcaggggaatcgactgaatatctttccagtccgttctgccattcacaccatgcttacgaattcatgattccatacagcccacttcccctcatcatatatgaagacgctgtgtatatcggtgaggctggctgtgtatatcccgtgcagagcggccggatgcacgcatacaggtaccgcaattccagtattgcccatgataatattgtaattgaaaaggacttttttgaacagatcctgcatgaaaaaggctgctatggaaaagagtttgatatgagttttgaccttacgaaagaggccggaacctacatccggtattttaaagaggaattttctaaacaaaataaccgtgattcctccaagcttattcatctctcggccctcattgcttctgtgttcacagattgcgaatttagtaaaaaaagagaccgcctgaaagctcctccgcagtatcaaaaaggaatctatcagattgtctcttatatgaaccagcattatgcggatgacctgcaggtagaaacactggcggccatgtgcggcctttcccgcacttattttataactgcattcaagaaagcagtcggcgaaacgccttataattatcttttaaaactacgcatagccaaatcgcagctgctgctggagaatcccaattactccatcaaggaaatcgctctgctgtgcggttttcaaaagccaaacacgttttcctccctcttccggaattataccggtatgacacctaccgaatataaacaaaaactgctgcttccgtgacattcactctccaattgagtcctaggctgctgaagtgagtgtttccacacctgccgcagactataacagattacatcgttgctctctgccagtctcctgtcttttctttctgctcctttatcttggatctcatagacatacagaagaccggcgtaatattatccggacggctttttgcagaccgtggcacatatagacccgctcccctgaaagatagggaactcttgcttaactatgccaaaaaagtttcaatattggcaagcagttctataaaccggcagtctaattctgccttttccgccgcgctctccgcagcaaaatcgaatcctggaataccaagcatcgcatgatttgcagcgctccagtcccgtactaaaatctgttccatctgctcccatccctcatactgtacaagaaaacagatctccagattgtatttcatattttcaagacacctgtaaaaatatggaatctcttccatctgaagttcatgaataaaatccaacagttcatcaaggcattttcttaacggaacaagatcttctctgtccaggctcttcatggtattacccccctcgttcaagcctgcaccgaaaaatcacccctgaatctttttgtattatatcataatctcatggaaatcactctattttccgacatattataacaaaaatcgacaaaatgtggcatccggtaaaaaccaggtatagaactcgttattccgcacatactattagaaaaaatatccttttggagggtgccttaatgaaaccttttaacaaaagaaataagcggctgtttatcagtacaatcatcggagtcatctttgtctctgctgcaggaacactgcttcattttgtctacagctggacaggtaataactccattatcgggctttttgcccctgtaaatgaatccacctgggaacatatgaagcttctctatttcccaatgttgttattctgtgccgcggaatacttctttctgtcgggacactatcaacggctgatccgggcagatctagccggcatactggcaggaacatgggtgattcccgttatcttttatacttacacaggaattctgggattccatacgctggcgctggatattctaacatttctattcagcgtcttaaccgcattttatgtgcgctgccactcccttctactgcccggacatatagagaacacccttttcgataaaatattcaaaacaaaatcaggagcgaagtgccggggactgtcgggccctgcctttttctatttcatatgtgtcctgattacaggtgtatgctttctcatcttcacttattaccctccggcagccggcctgttcgttttcccctcctgattaggttttctttgggtatccaatccctcagcataaaaaggagaaagccagcgaaagcttatccaattcggataagcagggctttcttcctctcatgtaccgttgctatatataaataattgtaactccggaaaagctcactttcccattgagcaccagagaaactgtcccgtccggctggcatcttcccttctcgtcaacccccccgaatgctgcgctcaactgatttaccacctgccagctgcgtggaatatagagttccacaccaccaaaggaaacatccagcttaacagctgcctgcccctgaggaacctgtgcatggtcaaagtacaccttcatggcaccgaaggaacaatggataccagctcccctgaagtcttcggagttaatatacttaatgctggagccaaaagagctttccatcctcatcgcatccccgtctatcgtctccacttcgctgaagctgccgtcaaagtgggtactgtgttgatgccagctccgctccggacggtacaaaaatgccgcgccgatacttccgagaagagccgctcccagaaccgtccatggggtcagtgccgtaattcccagcggctctgcataaataatgcagagaaaagccagagaaaacaatactcccggtatgcttctgtggatcgcactcttaatcagtgtcgctgcaaagatcacagacaagagcagcatccagatactgatccttgtattcaggattccaagtctgctgatgaccagaagcaccgccccaatgataaaaaatattccccagaataatcgttcttttttcatgtccttacctcttttcttccagccggtttcgaagcggcttgtaataatatctggatacatatacctgtttgtgtgtttccttaaactggaccacacaggaagtggatacggaacgattgattgcatagatgcttttcgtgttcaatatcgtagacttggatactctcatgaaatatcccggcagaatctcctccagttcatacaggcggtgccggattttgtaaatgtcatccaccgtatgtgcatggattgcctttccgtcagtctcgaagaaaaggatatcggtaagcatcagatagtactctgtctcttccttgtagaatacgatccgctgctcctgcctggagatttcgctcagcgccttctgcactttctgcacctggtcattcaggctgctgcttctgataatgacctcttcctctgttaaattctcatcaatttcaattcgtattttcatctcatttccctttccacccatttatctaaccatatataaactcccttgtaaatacaaaaggcgcatgtggtaaaaatgggaaggcaagtggtcagaaaacgagtctcatgtgctgctgcaaattaaacagaggtttttactatacctgctggactttatccgtccttcagtatagaataaatactgaaagaattgcaaaaacggaggaatcataaaatgaaatttttgatacagagagtatccgaggcttcagtagcagtggaaggcaatgtaattggttctattgaaaaggggtttctcgtactgattggcgtatccgacagagacaccgaggagactgcagacaagctggtacgtaagatgacagggcttagaatatttgaggatgagaacggcaagacaaacctctctctggctgacgtggatggcagccttctgttgatttcacagttcacgctgtacgcaaactgtaaaaaagggaaccgccccagcttcatagaagcaggccagcctgacagggcgaatgccctctatgaatatatcatagaaaaatgcagggcatccgtccccaatgtgcagaccggaagtttcggggcagaaatgaaagtcagcctcatcaacgacggtccctttactattattttagattcagaagatctgtgacatggtgcatcctgtcggtaggaaagttcgtcgcctggaggcggcggctgaacgggagcagcgtattgattcgtttggtggtacggaaattactgcaaaaaaatactccccttagggagtctgaaaaaatttaaaaagctgtcgagcggaatcgaaccgccgacctccgccttaccaaggcgacgctctaccgactgagccacgacagcctgtgcgcgttacttacgcaacgatattaatatacactaaacctagtctaattgtcaacatatatttgaaaatttatcaaaagtcaaattggatgtacctagcaaaaggacggcggctttaccttccttttgcggccccatccaacgcctgtaagacacttgtcaatactgctttttctcaataatctttaatgatgcgagataggagaccacagtcaacagtatacacccaatgcctgcaaacaacgccacccctgcgagtcctgcagatggaaggctgtcaattataagaaccagatctatccccatcatccccaaaagcttcaccacggcaaataccaccaaaaaaacagctcccaccactccgataattgctatcctgcttttatcaacaccgaatttcaactggacaggcagtgtaaaatctagaaatacaattgcaatgatcagataaaatatcatgcttatcacactttccgtaatatctgtcccaggataccggagtacagtaaatactaatacgattccacctgaaaccatccatgccacagcagcgatcaaaatccccagcatatatttctcgatgacatacccttttctggtaatgggaagcgtaaataaaaacgctcttccattgtcaagctcatcatagcttatggtggtcagtgtaaacattgtgaaaatgattgtaatataattcatgataaatagcagattcatatttgtaaatgccatcataataccaacaatacatataatataaaagaaattcagctgattttttagtaaacagagatctttaattattaaccctttcattttccttcacctcgtatcatcattgctattgtttcatcaatattaccgcgttcaattgtggcatccggataattatccaggtaaaactgtttttcatttgtcaggcagctatagccatagccttctctcttcctttttatgataaaacgcttatccagcttctcatactgtgcttcagtcaccttgattactccatagtcactcaggagcctgtcggtctcttcgtgcataataatcctgccgttatgaatcatataaatgtcatcacaaagtccttccagatcgcttgatatatgggaactgatcagaatggagctctctccgtcttccatatactcccgcatcatatccagcagctcatttctggccatcacatccagtccgaccgtcggctcatccaggatcagcaggctggctttatgcgacatcgcaaccaaaactttcagctttgctttcataccggtagaaaattctttgatctttttttcaaatggaatctcgaatgttctgcaccttttttcaaattccactttatcaaaccccggatacatactggccatcaccggaatgaggtcctttatacaaaggtaaccactgaaacccgagtcagaaagtacaacacccagtttttctctttcttccgttccaagcttcttgatgtcttttccgaagagttcgatcttcccgccgtcgatatcgattaatcctaacaccgccttaaatgtggtactttttcctgccccattctgaccgatcagtcctgtaacacatcccttgtgtacctccagagaacactgcagatcaaacttttcataatgtttttctacgttttgtaattttaataccatagctaatcctccaagataatctgaaataactctgtaatctcttcattgctcattccacagcttctccccttcctgatcgctttttccaggtcggcttccacttctttcttcttctcctccagcatcagttcctgattcgcacaggctacaaagcttccctttccatgaacggttacgacaaacccttcctgttccagggtatcataggccttttttacggtcagtgcgctgactctcagatccttcgccaatgttctgacagacggaagcgctgtatcttcttcaagttccccctgcatgatcttatttctgacctgcgctacgatctgctcgtagattggctgcatggaagaattgttaattatcagcttcattttctccctcctttgtctataaacagtatataacagtatgtcactgttgtcaactgttttatactgtttactccaaataatgagttgcttgtttactatgcacggcccataggccgttcatagtaactttgcttgttgtgactgttcagaccgtaaagtgaagcggcatattgcaacaaagaattttcaggcacgctccatgggcatctgcctcttaaatcaaaaaatctggcaagacctttccgtcattaccagattctttcatctatctcattgtaacagttcagcctgtctgagctgatacagctctttgccttgtcctcatctcgtatataaggcagaaaaaccgctatcttgccagcagcttctcggcctttccccgaatccgctggagcgcgttgtctatggctttgggactttttcccagcagctcggctatagttttataatccgttcccatcagatgcagatacaacacatggttttccagggcactgagatttcctttcagttcctccacaaatacctctgtcatctctctgccaaaatacaaggtctccggattattttccacaacaggttctatcgtatcaatcagaggtatctttttttcctcatccgtgccttccccggcctcatacagggaaatataagaattaagcggcatatgcttttttctcttggatgcctctattgccgtatacatctgccgggacacacacagttctgcaaagctggcaaaggaggcgccctgagaaggactgaagtcccttactgccttaatcagccctatcataccttcctgtatcagatcttcattctcaccgcctatgagatacatagctctcgcttttttacgaaccatggttttatactttaccatcagataatccataatttctgaattaccttttcgaaactccaatatcaactgttcatctgcaagtgtgtcatatttctccatcggccttttcctttccaacggtaatcctctgctctattgaaaatcacgccctttttagagcattctctgtcggacaatctcgtaggccagcacccccgccgctacggatgcattcagggagtcgatctcgcctttcataggaatagcggcaataaaatcacacttttcttttacaagacgtcccacaccttccccttcgctcccgatcacaagcccaatggggccggtcagattcagtttgtacatgaattctccgcccatatccgcgcagacgaaccacataccccgttcctttaattcttccattgtcttcgccaggtttgttaccttcgccaccggcgtataattcagtgcgcccgcggaagtcttcgccactacagctgtcaggccgactgccctgcgttttggtatgataacgccatgggcccccgccagattcgccgtacggatgattgcacccaagttatgcgggtcttctatattatccagcagaataaaaaacggatcctcaccctttttttctgcaagtttgaacatatcttcgatatctgcatactcgtatgcagcagcacaggccaccacaccctgatgcttgcctgtttccgaaagctgcgacagtctttcctttcccacaaaatttaatatggtatcgtgctttttcgcctccctgactattgtccgtatcggaccatcctggcacccatccaatatgaatactttatcaatcggcctgcctgaacggaaagcctccagcactgcattgcggccttcaattatcagcgtattgtcgttttgttctctttcatttctattattttcctgcattatattctccatttatatccaaagaaatcacggatgttcccctggtctttgactatactgtttcgcttaaatttcactcaggctgtccagtcctgcttttaccagagccatgagcctttcataatccttttttagatacaggtaaccgagcagcgcctcaaatcccgttgccctcctgtaatccgtgatggactgattctttgccggtgatacagatttggcatttctgccccttctgtagatggcatgctcttcttctgtcaggtgctgctgcattgtgcgcatcatcagagactgggtggacgcctgtacaaatctgcttgtctcttcatgcagtttatgcacctgtttatttccccggctgatgatcatagacttgataaccagatcgtagacgcaatcaccgataaacgccagaacaagaggtgaatagctgtcagcatccacctcttgaagacttaatacttccgttatataatcatgaaaatctaaatttatgctttcttccattttactccttctcgggtatcctccaggacgattcctctggagagcagttcgtccctgatctcgtctgctctggcaaaatttttcgcctttctcgctgcctggcgttcttcaatcagtgcttcgatgtcttctgccagcatctcctcgtccttctccacgataattcccagaacatctgtcagcttaacaagcagatctcgcaggttctgcagatattctgctgagctttcaccgtctgtattcgtattgatatatttaacgagctcgaatacagaggaaattgcgtctgccgtattgaaatcatcgtccatcgcccgctcaaagctgtcaacatattcctgtgtttttgcaaatgcttccttctccgcgtctgtcatatcctgcactttcgcattgcccttcaggaatttcagattgtcagccgcggttatgattctctccagtcccgttgcggcagcgtccataagctctgcactgaaattcagaggacttctgtaatgcgcgctgagcatgaaaaatcgcagaacctgaaggtcatatttttcgctgatctcccttacggtaaagaagtttcccagtgattttgacattttcctgttgtcaatgttcaggaatgcgttgtgcatccagtagcgggcaaattctttgccgttcgcagcctcactctgagcaatctcattctcatgatgcgggaatatcagatcttcccctcctgcatgaatatcgatctgctctcccagatattttttagacatctcagagcactcgatatgccagcccggacgtccttcgctccatggagactcccatgccggttcgccttctttttttggcttccataacacaaagtccagagaatcttccttttcgtcctctcccgttacaaggagtgaacggccgccggattgaaggtcatccagattcttatgggaaagttttccgtaatctttaaactttctcgtacgataatataccgttccgtttttctcgtatgcaaatcccttctcgatcagtgctccgatcatatccaccataccacagatttcttctgttgccagaggatgctttgtggcaggtttcacgttcatgccttccatgtctttcttacattctgcaatgtaacgtttggaaatctcatccgcagtaacgccttcttcgattgcttttttgatgatcttgtcatctacatctgtaaagttggaaacaaaattcacatcgtaacctttatattcaaaataccttctgaccgtgtcaaagacgatcatcggccttgcattccctatatggataaagttataaactgtaggcccgcagacatacattctgactttgccttcctctataggtacgaattcttcttttcttttagtaagtgtattatatagtttcatctgatttctcctctttcttttctttttctctgcatccgctgcactgtgcttctgctggctccgtattttccgcaaattcatcgccgtccggcagcatacagcgcatatgcctctccatttctttcagctgcttatacaggcgtatgttatcattctgaagctccctgatatcattcagaaccgggtcaggcagatgtatctgatccatatccgtcctcggtaccttctggtcacccatccgcacaatacgccccggcacgccgactacagtacagttcggaggcacctcctccaacacaaccgaaccagcccctatcttagagttttccccaatcgtaaaagacccgagtatcttagcccctgcgctgaccatgacattatccttcagcgtaggatgccgctttccctgctcttttcccgttccccccagggtcacgccctgataaagcgttacattgtctccgatgatcgtcgtctccccgataataacgccgcttccgtggtcaataaacagtcctttcccaatggtggcgccgggatgaatctcaatcccagtctttctcgcagccttctgtgacatccatctggccaggaaataatgtttcttcagatacagcttgtgtgcaactctgtacctaagtataactttaaaactcgggtaaagcaagacctccatattagatttaatcgcaggatcccgctcccggatgacctgaatctcattcttaatataagatataattcccatttcatgatcctccataccaatcgcatacaatatttaccaactctgctttcatttcaatccacttcacctgcccgaaattccagaggaatttccggtatcataaaaaagaccccgtctcttgttagagacgaagtcatatccgcggttccactctattaaaagaattacttctttcactcactgcatgtaacgtatgccaaacgtattccgctactcacagcatcccgccgcgtttacagaatcagctcccggacgcacttcacagactcctcctttagaaccacttacagccggtgatggtccctctctgcaatctcggaatcagctactctttccgttcatagcctttcacaaaatcaatatagatatatcttatgcaaaaaagagaaatttgtcaactgaattttggagcgcgaggtggggacacctgtccgggagtgttcagccctttcccatttgatgcgcccagctaacaccccacattacacgatttcattgaggtagagggggcgtaatggctctagtttccccagttcctgtttcagcctcggtgtaaggattacgccttcttcacggctgatttcatctattgtctggtaaccgaacagcaaagctgtcagggagtctattgtaagcactccttccgagtcctctgtttctgagacctgtatatccggattctccccgctgctcttcagcctccagactctgctgttttttgtgatgatggaatcaagtactgcaaaggagcagtttatctccctgcctgcttttgccctcatagaagccagaagtgtctccaggtgaagaatacgtaccatgatgagtggtactttcctgctccgggcattttctctgcctgcgtatatctttgcaggaacgccatgttctgcccgcatctggtatacggctttctggaattcagcttcgaatccgggtaggtaaagggcctctcggatctcgagcgtgttctcctccctggcatacgcgaacattccagctatagcgccgtcttgttttaatagttttatacccccgttttcactctgctgctcgaataacatcgtctggtaatactggtcgtcgcgcacggcgcagacctgatattgagcggcaaaatgggcattgaaaaatacggccattgcaccggcatccgataagccggcgtccgacatgctgactgacatggaacctggttctccgcaggattcttcctggatctgcgcgtagacaaaccggaaatcataaggcctgtatatggcctccgctgccggcatgaggaaagtaaatggctgcttcagtttatacatgtccatcatagaagctttgagcaaacggcccatatagcccctctttctgtatgcctcctccgttgccacggcaatgatataattgcataactgctgtgtcccgccgatcctcagcatgtaaggattaagctggagcatggaacggacagctccatcctcctcaattacatagatctgattgttcctggtctttataaaataatagtagtccagaaatgctttgctgtcttccggaaataccttctcccacagcgctcttgtcccgctgtgttcactgctgtcaagctttcgaagctgcattctatattcccctcttttcttactgcctgggacagcccttgcagccctcgcatccatttggattcggggttacatcgtagctgctgtagttcataatcttttccagagcgcacaccgcctgagaggaaatcccctctccgcgccctgtaaatccaagcccctcttccgttgttgccttgatattgacctggtcaggcataagattcagtgcatccgccacattctttatcatctcatctatatatgggcgcatcttgggctgctgcgcaacaatggtcgcatcaatgttctctatcacaaattgcttgtcatccagaagtgctgctacatgctccagcagcctgatgctggaaatgcctttgtactgcgggtctgtatccggaaaatgctttccgatatcccccagtgccgctgctccgagaagcgcatccataatggcatgtacaaccacatctgcatccgaatgtccctgaagtcccttctcatatggtatctctactcctccgagaatcagctttctgccttcgaccagcctgtgtacatcatatcccatacctacacgcatgttctgtcactccttattcatattctatctttcttcgtcgtcagtctcttccattgactcttccgtggtatccccgtttagatctatcagtgtatctgcagatgtaactgtgtcctgggctgcatcgtcctccatagcttctgcagttttcgtcctgttattcttctcactgtcatcatttggattcacttttctatcatctgaagaatctgtctccatggaatctgtgtcttccttcccggaaggcatttccgccgcagactcctcctcggtatcttccttttctgaagaagtctcctcctcagaatctgcttctattgcatcttcagaattgtcttcctctgaagatgcctcttcttcgttctgcattttgtttctcattgcgattacgctttttgcggatacaatcacgatcaccgctcctatcacaataaacaagatacccgcggtcatcataaacaccatgttttcgggtctttcagtaagcatcccgcttacgatctggtaccccagatagatcacatacaggccggctacaattctcaaaacgagccaggatttttcattcatttgtttgtcctccgtttaatttctcattctctgattctaacatacttagataagtattgccataatcagacacaaaaaagcttcggaaatttccgaagcttctcagtagcggaaactggatttgaaccagcgacaccacgggtatgaaccgtgtgctctagccaactgagctattccgccatataaaattttagaaagttatgggacctatagggctcgaacctatgaccctctgcttgtaaggcagatgctctcccagctgagctaagatcccatattctcccggtctgcgtttaagtgtttgtctcacccgcaacccgctttgctattatactattatttttcatcaaatgtcaacaccttttttcctgttttttcaaatttttttaacaaatcagaaacttcatccggcgctgatcatggaaccccttataaacacgggccgtatcccatttttaaatatttcgtacagcggatacggccactttttattgtaataatttagatctatttgaaatatttcacaccagattcaaagattttcatgtcctgttccccataaatatttatggcaaccgagttgtctcttctctccgaatgcgccatcttgccaagcacacggccgtccgggcttgtgattccttcaattgcgcggtaagagccgttgacattccactcttcatccatgctgatcacgccgtcaatgtcacaatactgtgtcgcaacctgaccgttggcaaacagtttatccagccattcttcactggcaacaaaacgcccttccccgtgggatgccggattcgtatacacgccgccaagagacgcctcctgaagccatggagatttatttgtcaccacttttgtgtataccatctttgagatatggcgtccaatggtgttataggtcagtgtcggagaatcctccttctggcctgtaatggtgccgtaaggcacaagccccagtttgatcagggcctggaagccgttgcacacaccaagggcaagtccgtctctctcattgagcagtttttctaccgcctctttgatctttgcattctggaaggctgtcgcgaagaatttggcagaaccgtccggttcatcccccgcactgaaaccgcccgggaacatgatcatctgcgcctgtgaaatggcgttttcgaactctgcaactgaatgacggatatcttccgcatccagattcttaaataccttcgttatcacctttgcccctgcgcgctcaaaggctctcttgctgtcgtattcacagttcgttcccgggaataccgggatgaatacggtcggctgcccgatcttatggctgcagatatggatatcctttgtatcatataaattgtcttccaatacttctttgctgtctgcagaagatcttgtggcaaatactttctccagagtctctgtccaggctgtcttcgcctcgcacagagtgatctccgtgtttccatagctgaatatgccgtcgtctgtcacttcaccgatgacagtatagctgattgccagttctcccacctgatcagcaggcacttccgcaaccagatctccaaatgctggcgcaaacagttctccggcatccaagctgtgttctatcttcaacccaagcccgtttccgaacgccattttactgactgcagccatcacaccgtgccggtccagagcatatgcggatacaattttgccattgtgtatatcgctctcaaactttccgtactgatccatcagctggccgtaaacagggagatcatatccatccttctcgattctcatccataccagcttatttcccgcctttttcagttccggggtaatgatatccttctccgttgccatatcgacagcaaaagaaaccagagtcgggggcacatcaatatcctggaatgttcccgacatactgtccttaccgccaattgagggcaggccgaatcccagctgtgcgtcataagccccaagcagagccgcaaaaggctggctccatctcttcggatcttctgtcattctgcggaaatattcctggaacgtaaagcggatcttcctgtaatcaccgccggccgccacgatcttagccacagattctacgacagcatatactgcaccgtgatacggactccagctggaaagatacgggtcaaagccatagctcatcatagaaacgctgtccgtgctgccattttgcaccggcaccttagcaaccatagcctgcgtctctgtcatctggtactttccgccatgcggcatgaatacggagccggcgccgattgatccgtcgaacatctccacaagccccttctgggagcatacattcagatcgctcagcatggccagccattttccttttacatcctgcacggcttcctttacaaaaattgtatcttctttatttggaatctccacctcaacggatgtctcctgatgggcaccgttcgtatccaggaatgcacgggaaatattaacgatctcttttccgcgccataaaagcaccagtctcggggactctgtaactactgccacttcaacagcctccagattctcttcctttgcataatccagaaactgttttacatctttcggatcgacaacaacagccattctctcctgagactctgagatcgcgatctctgtcccgtcaagaccggcatatttcttcggtaccttgtccagatctacacggagcccgtccgcaagctctccgatggcaactgagacacctcctgcaccaaaatcattgcattttttaatcagggcgctgacttcttctcttctgaataaacgctggatcttacgctctgtcggcggatttcccttctgcacctctgcgccgcaggtctcgatagactcttccgtgtggaccttggaagaaccagtcgctccgccgcatccgtcacgccctgttcgtccgccaaggagaatgatgatatctcccggatcggaagtctctctgatgactgcacgtctgggagcagcgccgagtactgcgccgatctccatacgttttgccacatagtccgggtgatagatctccttgaccgctccggttgcaagtccgatctggtttccgtaggaactgtagcccgcagcggctccccgtaccaatttcttctgcggaagctttccttttaaggtatcctttacagacacggtaggatccgcggctccggtcacacgcatggcctggtatacataggtcctgcctgacagaggatcgcggatcgcgccgcccagacaggttgcagccccaccaaaaggctcaatctcagttggatggttgtgtgtctcatttttaaaattaatcagccactcctcttccacgccgtctaccttgatcggcactacaatactgcaggcattgatctcctcagactcctcctgatcctggagattcccttcttttttcagctttctcatcgccataagtgccagatccatcaggcagacaaacttgtcctctctgccggcaaagatctcgctgtggtctttcagatattgtttgtaagtatttacgatgggttctttataatccccctcgccaaatgtaatctcctttaattccgtggagaatgttgtatggcggcagtgatctgaccagtaggtgtcaagcacgcggatctccgtcatcgtcgggtctctgtgctcttccccgctgtagtacttctggatatgcaggaaatctttaaacgtcattgccagtcccagagaatcataaagcttcttcaactcctcctggggcatattctggaagccgtcaaatacttttacatcctccggttcctcaaataccgtgaccagagtctccggtttttccattccggtttccctggaatccactgggttgatgcagtggttcttaatcgcaccaaactcttcttctgttactgttccttctattacataagtagtcgcagtgcggatgatcggcttttcatcttccttaataaactgcacgcactgttctgctgaatctgccctctggtcaaactgtcccgggagatattctactgaaaacacatggctctcctctttcagcggaaaactttccttataaagtgtatcaacaggaggctctgcaaatatcccactgcatgctttttcaaaagtggtatcggaaagattctccacatcatagcggatcaggacgcgtacatctgtcaccgtctgaattcccagatagtgtttaatctcatgccgcagttccttagctgaaacagcaaattccggttttttctccacataaacacgtcttacattactcataaacgatctcctttgcattttattctgccgcagttcactgcgctcttttctatcctatcacattttttctcattagtacaattaatataattaaacttattaattagtacagttaatctttgacttttttctccatattatgctgatgatcagcagtactgcaagccccgctataaagagaaccccaattctaataaccatatcagaaaacagtccttccgggagcattctgatcatataatcctccgccggatcaaacagccacaggtcatttgtaaagaaaatctcatgaaattttgtgaaggcagccgaaaaatccctcgaaaacaaatacgccaaaagagccgttcccgccgccgttagccccaatgcgatctgaaaagctctgggaatcagatatttccagcttgcctttgccgcaatcaaaactacgaggcagatcagcaatactgcagcagcccaagtcctgaggcgcagtcctccaatgaaaagtccctgcacatccgccatatgcagcttgtcctgttcattaaagaaatcctgttccttcccatccactgtagtgatcacctccagattctcccgatcccccttcagataatccatcatctcatgggtcacatacatcacatcctccatcttcatgtccagatcagggagcacgtcgtatttctcatactctttttcataaaaaccaaaatccgcatacatcgccgcttgaaagctcgtgatcagaaggatcaaaatcacagccagcgacagtataacgcccaatacccaatgtacttttttcatcctgccatctcctatcattcaataagtacagattttatactatccaacgtatttattttatcataataccgattgtaattcatctcaatttggcttataatacaagcaatacttattaggaggtctaataatggatatcaattatgaactgtacaaagtattttttcatgttgcatccaccctcagtttttcggaggcgtcaaaacagctttttatctcacagtcagcggtcagccagtccatcaaaaccctggaacgcaagctggaccagactctgtttatccgcagtactaaacgggttcttttaaccccggaaggagagattctgcttcgtcatatcgaaccggccatgcatctgattcagcggggagaagcacagctgctggatgccgcttccacgggagggcagatccgcataggggccagcgacacgatctgccgctatttcctggttccatatcttgaaaaatttcacaaagcattccccagcgcacacatcaaagtaaacaaccagacctccatcaaatgtgtggaaatgctggaatccggccaggttgacctaattgttgtcaactaccccaacaattatctgagcaacgtctcctcgattaagaaaatcaaaacattccgggatgtatttatcgcgaacgagtcatttcatgaactgaaagggaagaagctaacctataaacagctttcccagtatccgatccttatgctggacaggcacagcacaacgagtgaatttctccatcggttattccaacagcaccagctggatctggttccggagatcgagctgacaagcaacgacctgctcatcgacctcgcccgcatcggactgggcattgcctttatccccgactactgcatgacgggcgggcagaaagacatatttgttgtggagaccaaagaggaactgcccgaaagagaattagtcatcgcttataacgaacagatgccgctcaccagggccgcggaagaatttttaaattatttttaagaaggaaaagccgatgaatcataaaatattattagtagatgatgaaaaggatattgtcgacctgatcgaggaagtgctgcgtcaggatggctttcaaaatattgaaaaggcatataccggggaagacgccgtggagttctgcaaatccttcgaaccggatgtaatcgttctggatattatgcttccggacctggatggaatcgaggtatgtaagaaaatacgcggtttctctttttgttcaattctatttctttcttccaaaaacgatgatgtcaacaagatcctgggactgtccagcggcggagatgactatatcaccaagccattcagccccagggaagtcgtattccggatcaaggcacagctccgccgccagcaatatcagtcctccatccatacccctgagacggaaacagttgctgcgggccgccttctcctggacaaggaaagctgccgcattctaaaatccggaaaagagttaagccttacgggccgtgaatttctgctccttgcctatctgatagaaaatgcagataaaatcttaagcaaagaacgcctctacgagcatgtgtggggggaatacagcagtatctgtgataatacaatcatggtgcatatccgccatatcagagagaaaatagaggatattccatccagccccaggcagcttgtaacaataaaagggctgggttataagctgaagaaaagggtggattaaatgagaaaatctggttaccgcactgcttttcatatataccttatcttttttctggcgcttctcggcgcccttattttctctgccctgttttttttctcggttatcaccgtaaagtttcccgatggttctgtacaacgaagcgattatcccaaggcattcacagaggattttggcagacagattacttttatagatggcaaaccgcagataaaacagatcggaatcgaactgctccgtgcaaatcaggcgggtatccagcttttagacggcaggggcggggaaatcgccagttatcatagacctgcggatgcaaagacttcctattctgatgcggagctactgcagctttaccggacaggggagtttttcggtaccactgcgtttatcggaaatctgaatgataaggacaaagagttttcttacatcgtgtattttcctgtaaatataacaaaagtcaccatgtttctgaacggcgacaggttcactaccggtaaaacaatctttgcattgggcacaggagtgcttatcatgatcctccttgccggaagccttatatatggattctggatcacaaataaaatgaaccacatttctgaatgcgttcgttctatatcaaaacgtgattatacccctctcatagtcaaaggctcgtttggagacgtatatgaaagcctgaatcagcttgaccaggatatccgggacaccgacagcttaaaagaacagacggaatcgatgcgtgaagaatggattgccaatatcacacacgatttaaaaacaccgctctccccgattaaaggttatgcggagattctatttgaaaacggctctgttacaggcccgcagcttcataagtactctggagtcattttaaaaaatgtctcttccatcgaacggctcatcgaggatctgaagctgacttatcaattagaaagcggaatgctgccggttcagagcagaagacaggatttcgtgcgttttatgaaagagctggtcattgatatattgaataatcccgcatacgaaaaccgtgttatacattttgaatcagatcaagaacctatctattttttgtttgatgagaagctgatggcaagggctttccagaacctcatcctaaattcctttacccacggaaacagggatactgaagttgatttggagatcacgacaccggacaggatactcacaatcgttgtaagcgacaatgggcctggcatgaatccttccgaactgtccatgctgtttcagcgctactacagaggcgccagctccggacagaaaacggaggggacggggctggggcttgccatcgccaaaagtatagtagagacccagggcggcaggatctgtgcagacagtgaaatccatgccggaacatcttttaaaatagaatttcccacaatggtgtgaaataaattaaggttatttaaggttgtgtgaaaatcagattaaggttgatagtctattatagatttataatagctgtcagcctttttctaatataggaaattactctggaatttcctatatcatatcaccctcatgagcgaggggggtggggagctgaggtgggatgaccactttgttattggtaaaacagtagtctaaagaaagcaggtgtaaatgtgaaaattatttttaaatacattctaacgaatgtgaaggaaagaaaggtaagaacggctgtcatgctcttgtcaattattctctcgacagtcctcttattcgtttccttttcgatcggggaatcctacgaaaacgcacagagaaaaatggctcgcggtatgtcaggtacggcgtccgtctccgttacttccaggtctgaaacaactggcctgcagttagaggacataccggatctgccgggtatcaaggcgaaagccggactcctgaaggaagacgctttatatcatgaaaacggctattatgaatccattgacctgatcgcgtccgacctttctttattgaatcagataaataaaccccagctgagcggcggcggtgaaatcgaaaatttctccggctatcaggtgatcttaccggatcggtttacgcaaaagtatggcatcaaaaagggggatcggataatgctgcagataaacggcgcttctgtcggatttgaggttgcggcaattgcaaagtatgataccgtttttctgcgtcagaccagaggtgcaaccgcccttcttcccttggataccttggcggaaatcactggcagcccgggttacagcgaaatcctgatcgagcctgcagacggtatttcggcagaatcactggcggcttcgctcttgggcgaattatcagacagtatatttatcgttacacagatcgttgacgaggcagctatagcggacggtgcccgacaaaagacaatgccctttttcctgatcagctttttctccctgaccatgagtgtcttcattatttacagcagttataaagtcatcactctggatcgcctgcccgtcatcggcacctttcgcagtattggggcaacgcaaaagatggtcaccggaattttactcctagaaagtcttttctatggctgtgtgggaggccttgcaggcataccactcggaatcctggttttaagaatgatcctgcggggaatgagcggcacattatcacagggcatagaaatctcccccgtgatttcctgggctggagtcttactttcctttgcggcagcagtgattgtcacgctgctcagcgcatggtttcctgtccgaagggccgggcggcttcctgtaaaagcagtcgtcttaggggttgtggaggaacaaaaagcctccagccgttttattatggggaccggtgctgttctgtttgtcatttcagccgtactcccctatctgttttccggaacattgctgtatatagccggatgtttatcactgcttgggctgatcgcagcggcaattctggtcataccgcttgtcacgaacctgctttcaggaatcctggaaagaatatacgcggtcctcttcaaaaacgagggtatgcttgccgcaagaaatatgaagaataataagaattttacgcagaacatcaccctgctgtttatcagcatatcagccttgattgccattacggtagtgggagggtttgtaaatacttacatcaccgatgtctttaatggcgccgaactggagggatttgccgacggggaaatggatgaagtttttgtagaaacagtgcaagaaatggacggaatcgataaggtgctgcctctttatgttttcaataatcaaataagcagcggggacatcacatttacacgtttggaggccaccgaccatttagactggtataattccatgttcaatctgaactacaccaagcacaaaatggaagaccaggcctcggaagattttaagacgcagcgctccatcttattaagtgaggactgcataacccgtactggttacaccgttggagatcatctgaccttatcagacagcgacagggactattcctatatcgtcgccgggagttttaaatcaagagcaaccgatgtggaggccattatcccttcccgctttgccatttccgattttcacgcatccaccttccattttctggcttataccgcagcggatccggaagcggtcatggttcagatccgcagtctgttcggcaaaacacagaactggagcagaaccgtcgaggaattcaatactgacgctcataccaccgtcggcgcgtttctgaggcccatgcagagtatgacttacttcatactgctgctggcagcagtcggtaatattaataatctgctgatcaactatatacaaaggcgccggaccattgccatgtataagtccgtcggattaagcaacaaacaaaacacaaaaataatggtaattgagagctgcaccgccggaatgattggggcctttgtcgccgtgctggtctcctatctggaaataaaaacaatatttctagtagcaggccccaagatttccatgcagccggaactggacattgtaacctttctatcagccggggcaatgggaatagccgtaactttggtcagttccgtcgttccgattataaaaacccggaatatgaaattagtagaagaaatcaaatttgaataactggaggtctgacagatgaaagcaatgatcaacgatacagccattgaaggcagaaatattatcaaagactttaataatataggcggcacaccgacacggattctaaaaaatatatcgctaaaagtcagaaaaggggatttcgtctctattatgggtccttccggatccggaaaaagcacattactctacatcctgggcggtttggatgttcccagcagcgggtccgtatatatgaacgggacagacatctcaaaatttgacgaccataaaatgagtatcatacgacgccgtaaaattggatttgtattccagttttataatctcatccccaacttaaatgtagaggaaaacgtcatgcttcctctgctgttagacgggaaaaagctaaaggattacagaagcaggctggatgacatccttgaaactgtcgggctggcagaaaggaaaaagcacacacccagagagttatccggggggcagcagcagcgtgtcgcaattgcgcgggctcttattggaaatcccgagatgctgtttgcagacgagcctaccgggaatttagacagcaaaacaggtgctgaaatcatggaattactacattccattaataaacataccggtcagactataatcatggtcacgcattccgcggaagcggctgaacgcagtggccgcatcattacaataagggacggagtgaggtgcgttgattaattttgggaggggcgcttaatgaagggatctccgtcagacttccttcatttcgctggatgcatccaatcggaagagtggcttggcaaaggtggaggctccgtagcgggggcagcgtattgattcgtttgggggatcatatatttttcattactttatcctaagcatattgtatccttaaacggattcatacgcagccgctatccgtccgcaaggctagagcttgcggacttatatctgttttttgtagtaggtggggatggaaattattaagaaattataaaattagcactcacctattgacagtgctaataatcatatgctatattacatgtagaacaaagataacaaattgatttttaggaggtatgaactatgttattatcaaacagaagtttttttaatgatttctttaaagacccattttttgaaagaccttttgacaacgcttcatcccagatcatgaagacagacattcacgagaaagacaataactacctcgtagaaatggagcttccgggctacaataaagaggacatcaaagctgacttgaaagacggatatctcacaataaccgccactcacgaagaaagccaggaagaaaaagacgaaaaaggcaactgcatccgcaaagaacgctataccggttcatgtaaccgcagattctatgttggtgaccaattaaaacaggacgacattaaagcatcatttaaagacggcgtcttatgcctgtgcgtccccaaagaggctccaaaggcaatcgaagaaaaacctaaatacatcactatcgattgactttaagtaaaacctctatgtgtagatgtaaatcgtctgaccttttgaaaatgtatatacgtaaaaaagcaggaaacccagtgtttcctgcttttttatgatatatagccaccgagccggcctgcgtccataacagttcctccggtcactattataccaggctgtccgaaggttctccgccccagaattcctttatctttaggccaaggttatctatcctgcagatctggtacccctcccactcacgcggaaatatctcccggtactgtctctgcacaaaccgctcatccagcagtataataacgccacggtcctcctccgttctgatgactctgccggcagactgcaatactttgttcatccccgggtaaagataggcataatcaaaccccttcatgtttctgctgtcaaaatactgtttcagtatctctctgtcattgcatacctgcgggagtcctgttccgataatcactgccccaatcagcctgtcctgggtgaggtcaatgccttccgaaaagataccgcccatcacgcagaatcccacaaggctgcactcccgcgcctcctcgaatgtctccagaaagatttctctggcttcttctcccataaactgcgactgcacaatacattctatgtcgtggcgcccctgcagcatattctgaaaacattcctgtacatcttccataaaccggtaggacggaaagaaaaccatataattgccctttctaccctccactatattaagaatatacctggcaaacttctcgtacatgtctgctccccgcatggtatactttgtgctcacatcgttgccaagaagaagaagacggttctcccttgggaaagcggattccgcatagattgcataatcatcactctccacgctgagcagctttttataataatggatgggcagcaatgttgcggaaaaaaatatggtactgtttccctgctccaagtaagtctgcagatttacagaaggattgacacagagcagctttacgcggaaacggccgccacgttcaagctccgaatagatgacatagttttcatctaaaatatcatgaatattcaaaaagtctctgacttgaaaataaaaatccaaaatctgctctcttttttcctcgctgtgttcttcctccagatactcctccagaccggacattacattcatcagcttaaccgcgatgtgggaaacactttccagaatctgatagttctcacactctcttttcagcataagcagctgcttgttgcactcctccagttttttcgccagcttaggatcttcgttttttaccaggcgctttatctcaagcacatcctctttatataagacagcgctgtacatctcgcgcccccgttcaaccagattgtgtgcctcatcaatgagatacagatagccgcctttatttccctcggaaaaaaaacgctttaagtgagcgtttggatcaaaaacgtagttgtaatcacagataatggcatccgaccatactgaaacatcgagcgccatctcaaacggacacacattgtacttctgcgcctgtttctctattgcctctctgctcaaatcatccgagttcataatcaagtcaaacacggcatcattcactctgtcataatgcccttttgcgtatgggcagttgtccggattgcagactgtctcttcgcaaaagcatatcttttcttttgcggtcagggtaatcaccttcatgaggagcccttgacccttcagggtctgaaaggcctgttctgccacggttcttgtaattgttttagcagtcagataaaaaatgcgttcccccagtccttcccccatggcccgcaccgccggaaagacggccgccatggttttccccacgcccgtcggggcttgtataaacaacttcttctttctgagtatcgttttatagactgaagtcacaatctctctctgcccatccctgtactcaaaaggaaactctatcttcttaatcgatgcattccgctccgacttccattcgatctgaaacttcgcccatttttcatacttaacaaccagctccagaaaccatttttccagttcatccctggtaaactcccggataaatctcttcagttcttccgtctccagattacagtaggtcatctgcacacggatgttctgcagattctcctgcctggcatacatatatgcgtagcacttagcctgtgccaggtgtacattggagggtgcctcgatatgcaggagttccctgaggacgcccttgatttcatctatcatgacgccctgcccatcctcgatgactccgtcggccctcccttctacctgcagggtaaatccttcgcagggaatctgcgttttgagagaaacctctgcacgataatcagaacccatacgccgctgtatcctgcgatggattctgcttccctgcagcatggcctctttgtccgcgctgctccctgttctgttgtcgatgtccccctcgcgcagaataaattccaccagattgcggacagatattttgatcacttctttttcttccatgtatgttattatacctcgttcaagcaggaaaagccactcttgttacctctaaattactacggcaaactgaatataattctctccgccgatctcttcctgccccacggtaatctcaccccccgctttctctgcaatcattttggcgcggtagaggccaagccccctgtcccctctctttttgctcttcgtagtaaatccattctcaaaaaaatgtccgatctcttccagtgagatcttctcgtgctggttgaatatctggaaaatcagatgatcctgccgggaatccagaatcatgcgcactcgtcccccctcctcggggcacgcctcatacgcattgtctaccagaaccccaacaatctcaatcagactgtgttctgatacccgggaaataatctccctgctgcgcacctctatctctgtctcaatgccttccctggaactgacaatcttactgtaaagaaagcctgcgagcaccttatcactgattttcagaagaggcagatactggctgacgccctctctgctgatcgccttcacatactccgactgtctgcgcacaagttcttcataagaatccacagtaaggtgcatgttcaaaacagcattcagatgattgtcaaattcatgctgccttgccctgatctcctttaccagttcctccagcggttgaatatagtgctgatacatcttcagttccttttcctgctcccttatgatgtcattgctcagcttccagtcaatcgtcccccatataatcacaacaagtaataaaatgaatacaatgatcatcttaaaatccagcgtcctgcttatcttcaggtcaatcaccaggtaaactgcaatcgcaagggaaatgaaacaaaagacccggtaaaggaattttcttactgttttattcatttagcagcctcctgacctcagtcttgtaggtaacaccgatatcaattttctctccatatccctctacctgtatcatctgatttaccatatcataatacttcacgtatgtcttattcaccgcaaacatcctgtggcactggaaaaactcctgctttggcattttctccataagctgccgtatagagagatatggaatttccatcttctcctctttcagataaaggcagacccccctgggaattgccttacagaaaacaatctcttcacacaatatcttataattaatcccgtttttcttaactataatgtacggtttttcctctgctcgcacgtgggacagcacctttttcaccacggcctgtacatctgcttcgctgtaaggctttaagagatactgataacagtgtatcctgcggtaagcctctatctccagggacgcaaccgatgtgatcataacaacaggtgtgaactcatacttgatgatattgcgtatctcctctgcaaagatcaggccggaggagtcttccttgtcctcttttacaagatttacatccagtaaaaataaatcaaaagaaacggtgccatgcagcagcagcctggcttgcgccaggtctgccgccgtattcaccgttatgtcagccgatatgcggcagagcatgttccgcagtgcttccctgctccgctcctcgtcttccaataccaaaattcttgccatatcctgctcctgcttctactgccttctattgtgcggcacgcgatctccgattgcctgattccgtccaggcccaaaccggactactcagccttctcgtaatgcgcgatttctgaaattgtcttagtcagaccggcaattccctgcagttcggatgggatgataatcttggtagccttaccgtcagccgcctttgcaaatgcttccaggctcttgatcgtcagcactgcttcatcagcgccggcttccctgataaacttaataccatcagccgtagccagctgtacggatctgatcgcttccgcctgtccttcggcttccttaatcctcttctgcttctcggcctctgcctttagaatcgctgcctgcttcgccgcttccgcctcaaggatcacggactctttctcaccttctgccacaaggatcgtagacttcttctcgccttctgccctgaggatggattctcttcgctcacgctcagccttcatctgcttctccatcgcatcctggatagcctttggcggcataatgttctttagctcgacacggttcactttgattccccatgggtcagttgcgatgtcgagagatgttctcatctgggagttgatcgtctctctggatgtcagtgtctcatccagctccagatcgccgataatattacgcagtgtagttgccgttagattctctatcgctgcaatcggactttctacgccgtatgcatactgtttcggatccgtaatctggaagaatacgaccgtatcaatctgcatcgtaacattatcctttgttataaccgcctgtggttcaaaatctaccacctgctcttttaaagacactttctttgcaactctgtccagaatcggaattttaaaatgcaggcctactccccatgtctctttgtatccgccaagacgctccagtatatacgcatgtgcctggggtacaatcctgatatttgtcaccaggattaacagtacgataattagtattacaattccaatccaaagtcccatattctattcctcctcatatttctttacaatcagtttcacgccggaaatgcttaccaccttggccagtgtcccgggctccaggatatcctcatccttttctgcccttgcggtccactccagcccattgacgacagcggttcccgtctgtgccagattatctacagtctccgtcaccctgactattttacctataacgccctcataatttgtcttctcatgatgggcatttatgtattttaccgcaaagggacgggtaaaaaacaaaagtaaaaatgagacaacgaaaaatgcgccaacctgccagatcaggttcataccggcaatgtttaaaagcagcgctgccagagcgcccccggccagccagaccgatgtaagcccgaccgttataatctcgattaccagaaaaactatcagcagtccaagccatacaaaagcttctctctccatatttctcccttctctcagattttatttcatccggttaataacctttcctgatgatagttatatgttaatccagcttattctattatacaatactttttgcgtgaatgcagtgaaatcctgttttaatgaaattctttaacagttcaggtaaatctgaactgttacgcatccagccattaaaatcgctttgcgatgggatggatgcctgtggccacctcattttcctacggtctgcgctgtaaatgcgcagacctgactgcgctgtcactaaattctgtcatatcctgtcggaaatgcatcggcaggtgtgacctctgcagggccagattctcacgctctttgatcgaaatcgagctgcagaatcctttccataaacgctcaaattccccttcagcctccgatactctgcctgctgtctccggattcagttcctctccctggacgagaacccagttcttacctgcctgatgaaccagaaataccttatgcgttttatcataaaccatccagttctccagcggaaaacgatttgtaaaatgatctgcaatgcaggtcagcacctgccccttaggggtaatctccgagagcaggactccgttctccagttcccgaaagcggatgaactccgtaaacagatgcgcttcattggccacgctcctgctcagttcaaacaccttggcaacatatggattactcaggtgttccatgaccttcctgctgtctggtatggttctggctgccagcatggtgttatatacggcatccgccttctcggaatcgtctgccaggagggcatgataaatatcccagtaagtattatacccaagattctgttttatcagccgctcaaccgcaattgattttttttccgactctgcggtctccctgtactcacagaacagctgcggggtcatctggccgcgcagtgcaataccagcttcaccgtttctattttctttccacgcatcgtggatagcggaaaatatgcctgttattgtgtcataacaaatatagacctgtttcatctctgtccctcttttactccaatatgctgaaaacctgtgcttccctgaaggtcacatcatcaaacaaagaaagctgccggtaggtcataccggtcacagaatccggcagcttctcctttgtattcagtaagtttctcataatataatcctcttctatcctggttttgtacatcattctgccattacatgtcagaaaataaagtgcacgctttagaacgactcccatcttttttaaatcttcaaactgcagagttcccatccttctcgccttcacaatcctggcagccgactttactccgattccgggcaccctcaaaagtgtattatagtcggcccggttcacctccaccggaaaatattccagatgctttatcgcccagtcgcactttggatccagaaaaacattaaaattcgggttcttttcatccagcagctcccttgccttaaattggtaatatctcagcagccagtccgcctgatacagtctgtgctctctcagaagaggcggcccttcccctgttctggctggcagagccgagtcctcattcacagaaacaaatgcggagtagaacaccctcttcagttcgaatttcttatagagagattctgccacattgaggatctggtaatcggtctcaggagcagcgccgataatcatctgtgtgctctgcccggcagggacaaaccggggagcattcttatattgaacaatctccagcttattgtcattgtgcttctgctgtaccagacgcatcggcgccagaatattcttcctgctcttgtgaggtgcaaggagccgcagactctcggcggtggcaagctccagattcacactcatcctgtccgctaaaaaccccacccgctgaatcagctcctgatccgctcccggaatcgccttcacatgaatatatccctgaaaattacactccctgcgcagcttgtacagagcagcatagatcagctccatggtataattcggcgtcttcaatatcccagaactcagaaaaaggccttcaatataattccgtcggtaaaactccatagtcaaagtgcatatttcgtccggcgtgaacgaagtcctgactacgtcgttagacgctctgttgatacagtatttacagtcataaatacattcattcgtaaataaaatcttcaataacgaaatgcatcttccgtcagctgaaaagctgtggcatatacccgatttcttgcagtttcccatccctgtcccgtcaccctgcctgtccacaccgctggacgtgcaggccacatcgtatttggcggcatcgcttaaaatctgcagtttgtcatacatcgacatctgttcctgtataatctccgccatctccgtgcaccccttttcctataccttattccgcagttttctgcggatccgcccgcagggcatgaattacgggatgccctttgggtatactttcttcaaataaatcctatagctatttcgaacatctgttctaactataacaaatcataccatatcttccacgcattttcaatagggagttagttaacgagctttagactcgttaacggatggaggacgcgaatgacgaggtgagtccgggagctggtggggcaatgtctgctggtgaaatgtcctgacacttcgcgaagaagctgcagaagaaaacggaacgggaagggaggtacatgccgcatttggcccgaatgccgatgcattcgctgttgcatccaaacggtagttaagagctcattccccagaggggccctcgtacggtagcaacggatggaacagaattggtgattcgtttatataagtgtaagtgttagatcgccttgttacccgtaaatatactggatttaaaaaattgtatggttcattcataaaaaagcatatggagttacacacgataatcgttactaaataaatagatttcttcaaaaacagtccccaaagctcccatacataaaagccttaaaatccatttaatcaagatgcatgatacgcatagccaatttcatccgcctcccccgtctcgggctccaccttaggaacgagtctttgcctaccggtcggatgcaccagccaagcggactgtaagcggcaagccctccgacctgtatggtcggtttaaaaccccttatagcggacgattagaagctcttagagagccggaggcatccggaagggatgaaaattgattctccgaaatcaattttcaatccggcctgtactgaaaaaatatcatttttttcagcgcatgccggatgtgcccttccaggtgcctccgggtctcttagagcttcttcgttaagcggtcaggattttaaaccgaccatacaggccggagggcttgccgcttacagttcgcttggcgtcccccatccgtgccgagactaaagctcgtcactaaatcccgatttatttttgatcctgcggcaccgagtttttcccaaatactgccatcaggataattgccgcagcaaaacttacgatacatgcgataatagccgccacaaccgatgagtcaaatcccgtctccggattgataacctgcagccatccgaagatcccgtttgttccatagaaatattgttttactccgccgaatcctatgattgccccaccaataccagaagccaggcacgccaggataaacggctttttgaactgcagtgtgacaccatagattgctggttctgtaatacctaccatggctgaaaggattgcagggccgcatacgcttttgagctttttatttcttgttttgagcataatcatcagtaccactcctgcctgtgcaaatgcggaagagagacctgcgattgtgatcgggtcgaatcccatggtcgccagattatttacagaaattgcaacgaatccccagtgtacgccgaacataacacatacctgaattaacgcgccatataagaaaccgctaatagtcgcgttgagatcaaataatgccgtaaatgcggctccaagcaggctgctcgcaaaacttgcaaccggcccgataatcaaaaacgccaggacaatgctgatgatgagggtaagcgccggtacagcaaaagtcttgaacaagtcgctcatcctctttgcaaagaatttttccacttttgcagcaaagtaacatgtcacaatcgccggtatcacagagcttgcatagttcatcagaatgaccggaattcccaggaatgttacgtagaccggagattcaaaaatggttcctgcaaacagtgtgtaaagcggttctcctgccataatcgttgtgagggatgggtaaaccagcgctgctccaatggccattccgataaacggcgtgcccccgaatttcttcatcgcggtgtatccaaggaataccggcagaaagttgaaaaagcagtcgcccacaatgttcaggatctgataagtacccgatgcggttgaaagcaggccggtcgcggtaagcagtgccagaagacctttgattacaccggttgcggtaagcattcccagaattggcgtgaatacgcctgatatcagatcgataaactggtttgttacctttttcttcttcatttcttctttgaattctttggcatctcttacttccgtcttttcgccgtccgcccccagcatggccagcatttctttgtagacatcccctacgtgctgtccgatcacgatctgatactggccgccgcttttcacgatggatagaacaccttcaattgctttcaccgcttcgtcatccgctgccgcttcgttcttcagttgaaggcgcagccgtgtcgcacagtggtagacgctggttatattgtctcttccgccgattttttctacaatctcttcgatcattttttcgtacttcattcgttaaatcctccttcgctcaattccgtaaaatcaaaagtcatactctgttccttttgaaacttaatcttctgccgctgtcctgttctgtctgcaaatataactgcagaatctcggagtcccagcagcctgatctctgtaatctgtgagtctttccactccagatccagaatacatccgcacttcaagcggattccctgcacctttccattttttaatgcctgggggagggccgggagcagaaagacgatatcttcaaaatcctgcaccagcatttccagcagaccgcaggcgcccccaaagtttccgtctatctggaatggcggatgcgtgttgaacaggttatccaacgtggcgccagtcagcagctcacgctgattcttccacgctttttctccgtcccggagccgtgcgtaaaacagaataatccaggccttgctccatcccgtatgtccgcctccatgactcaggcgtctctccagagtatgaagcgctgcctgcgccagcccgggcgttgtgtccgggcgtatctgcgctgcagggtagagggcaaacagctgggagatgtggcggtgtccgatctccatttcttcatagtccttccgccattcctgaatctgtccgtattttccgacttcgatggggggcagcccttccaggcgtattttcacatctttttccagttcgtcttccaggccaagttcttctgtgatcctgatatatccgccaaacagttccctgaggatttccgaatccatggcaggccccatacagagacacccgcattctccctgctcattcatatagatattttccggggaactgctcggccctgtcatccagtatccctgctcgtcctgcaccatataatctgcgaaaaattgtacgctgtccctcagtattccataaaattcttccataaattcacggtcttttgtatacagataatgttcaataatatgaagacagagccaggccccgcccattggccatatagttgccgacacatggctgtcctgcggtgcgcagtccccccagatgtctgtattgtggtggcagcagaatccgcgcgctccatacattttctccgcggtctcctgcccatgcggccgcatcgttttcaggtgctccaatagcggcatgtgcagccgggaaagccccgtcttttccgccatccagtaattcatctgtatattaatattgatcgtatatttggagccccaggccggctcaaagtcttcgttccagattccctgcagattggcaggcaagctgttttcacggctggaactgatcaataggtaccttgcaaaattataatgtagatttaccagaccaacatcctcctccccgttcctcatccgggcaagacgttccggggtggaaagcctctcaaattcctcctccttcccgagctccagtacactgctgttataaagtgcatgataatcatcgagatgctgtttttttaacttttcataaggctgggtaccggctgccttcaaggtttccatacaccacgcggctggatcttcgctccggtaagtggtcctgccggttataaaaagcaccgcctccttcgcgccctctacgatgatatgactgcccatgcggtacctgcgccctccttttgaggcaatccgcaccgccatctcaaaggcgatcccgttatccgcaccgtttttaccgtacaggcggatcgcatcgtctcccagtgcttctgtaccgtcgcaaaaagacgacccccttcccgatcggttgtcttttcgggtaagtgaaacctcaaaatccaacacctcatctgcatctgcgtacattttataaaccagaacctgtgccggggcagaggcaaaaaattctctttttacagatcccttctccgtcttatatgcaatgctgcccattgcatcctccagattcagtcttcttcgatatccttcgaataccggcggttcatactccacaaacgaagttccgttctctttcttcttcacgatctgcctgccgcgtgtatgaaaaaaatcaatccatacatctcccaatgtctgatagtgcctcatatggggataggatgcatacatactgcgggaagccagaagttccgcctcctgcactctgccctcctttagcagctgcctcacttcatgcagatgctcttttgcatccggattgacccgttccatgtatccgcctgaccagacagaatcctcattcacctgtatccgttcaacagatgtcctgccaaagaccatagcgcccataaaaccgtttccgatgggaaatgcctctgtccactcctctgcttcgttccgaaaccagatctcattcatcgcaattctccttccttcaaatttctgaggccattatagcaaaaaaaacagaagttccgaaaaagttcgcaaaatggaaactctctcaaaacttctgttattttatcctaatctttacagcaatacataagattaatcaatgattacatcctcaggaaagccgtacttattctgataccttgccgtaatctgttcgattaggaactgataaagaatcggatgattctgaacccgctccccgtattttagaaaaatgcacatatccactctcggatccttttccatctttgtgttagatgtaatcagaactacccttgcttttgttttattaaaacattctttttcaggttctccgtccagtttagaaaacgtgctgatatagcgccctgaattcgagaaaattaaaagcagtgtatctgcgccggcctctgcaatataatgctcctgcttcctgtcattaatcgttgtatagacatattttctgtagtaggacattttgtattgaaaattcaacgctgccgtctcggaataaatctccccaaaagcggcaattttcttataaccgtggatatcctccacgaggcgttctatcctttccgtatcgatggaggccgcctgattcctgatatcattcgtcagcacctgaacataacggtccatcccgtactccagaatatagtccgtgatattcaccgaatctccgccccggatataaacatccttttcacgctggcgcatggcctccagcttgaaatccgtatagtcgtcaaaaccaatccttctcacaaacttggataccgtagactttgatacactgcacagggcagccatctccccgatcggtatctgatacagctggttgatattctccagcatcagactggcgatgtggtattctgtggtaccgacaatctcctcattaattgtggtgatcaaacgctgatataaaatatgcattgtctttttctattcgcattctctgattcgctttctcagcggaagtatcatagagggagatacggaaagctcgtcaagccccatcttcaggaattcttccgtcagttccagatcggctcccagttcaccacagataccaatccacttgccctctgcatgagcattctcagctgccatcctgatcattgcaagcactgccggatgatgtggatcatagaatgcatccagtttggaattctgcctgtcaatcgccagcgtatactgggtcagatcatttgtacccacgctgaaaaagtctacttctttggccagttccctgctgatcatgacagatgcaggtgtctcaatcatcacaccggtctctacattctctttaaacggaattccctccgccttcagttcactctgcacttctgcaataatctctttgatcttgtatatttcatcaactgaaatgatcatcggaaacataatggagatattaccgaacatagctgcacggtaaagcgcacgcagctgtgtcttaaagatctctgttcttgtcagacagatacggattgcacggtatcccagcgccggattctcttccttgtccagcccgaagtaatcaacctgtttatctgctcctatgtccagcgtacggataataacctttttgccagccatattttccgcaacctgtttatacactgtaaactgctgctcctcggatggaaacgtgtcgttctccaggtataagaattcactccggaacaggccgattccgcctgcatcattcttcaggacagcgccaacatcggatacattgccaatattagcatatacattcatcttctggccgctctttgttacattctctttgcctttcagctgttccaggagggccttctgttccagatcctttgcccgcttttcttgcatctttgccagcgtcgtctcgtccgggtcaatatacagcattccggtaaaaccgtcaattattgccattctgccgtcatactgggccgctagttcctcgcccaggccaatgactgcaggaatgttcatcgttcttgccagaattgccgtatgggaattggaagaaccatacatggttgcaaatccaaggaccttgctcttgtccaactgtacagtctcgctgggggccagatcatccgccgcaataatacacggctcatccgtctgagccatactttctcccacaccgcagaggatgtccagtacacgctcggatacatcctttacgtccgccgcacgcccctgcatatatgcatcatccatagaagcaaacatctgcgcaaagttgtccgccgttgttgctacggcaaattctgcatttacttcctgggtacgtataatattttcgattgattcaatataatccaaatcttccagcatcatctggtgtatctcaaaaatcatggcattcgcttcgcccacatcctcaagcgctttgtcatacagccctttgagctgttcaactgcctcggcctttgcctcctgaaaacggatgcattccgcctccacatcatcaacgtgtgaccgcttgatcactttttggttcctcttataaaatgagagctttccgatggatacaccgccaaatacgcttttacctgttattgtaatcatagtaccttcccttatatacaaatgataagtgctcttttatttataaattttctttaaaaaatgcctctaattctgcgattgcctgatcttcgtcttcgccctcggctgtcatagtaatctcttcccctgtttttactccgagtcccatgactccaaagattctctttgcatcggcactcttctcgcctttaacgattttaacggcagatttatagcctgcagcctgctttaccaacagccctgccggtcttgcatgaattccctccgggtctgtaataacatatttaaattctttcatgatactattttcctcctgttttttatttttaacttcaattagtatataacatatctccgtttttttcaattgcttataaattatttcacactacatttccatttaagaactaaaaaaacgacatttcaaaggcattttgcagcacgctccctgcggattctccacagggcaaatgccgcaaaatgcccttttttatgactcaaacaacggtgtagaaagatatctttctcctgtgtcaggcaggatcgccacgattgttctgcctttattttccggtttttttgcagcttcaaccgccgcatggagcgccgcgccggaggaaattccaaccagtacaccctctctccttgccagaagttttgcagccgcataggcttcctcatcctttacctgcacaatggattcatagatatctgtatccagtacttccggtatgaaccccgcaccgatgccctgcagcccatgtggtcccggttttccgcccgacagtaccggggagccggccggctccactgcaatcacctgcacatccggctttctggacttcagataggttcccgttcccgtgatagttccgcctgtgcctacgcccgcaataatgatatccacctggccatcggtgtcctcccagatctcgggacctgttgttttcgtatgaatttccgggttcgcactgttcacaaactggccaagtacgattgcattttcccgttcttttacaagctgcgccgccttcgcgatcgcgccgttcattcccttcgccccttcggtcaggacaatctctgcgccataacccagcagaagctttcttctctcgatgctcatcgtctcgggcatgacaaaaactgccttgtatcccttggctgccgccgccgatgcaagcccgatcccggtatttccgctggtgggctcaataattgttgctcccggtctgattaggcctttcgcctccgcgtcctctatcatattcagggccacgcggtccttcacgcttccggccggattgaagtactccagctttaccagaacgcgcgccaccaggttcaattccttttcaatattcgacacctccagtatcggtgtccttcctaccaattctgtaatgcttttatatatatttgccattttgcttcctccaattctctatctatatttttatagctgaaagcacataagtaaccggattttggtctcttatgtgcaatgcaaaataagtaaccgtccagatcttcacgagccttacaaatcttattatattcgttctaaagcctgttccaggtcatacaggatatcatctatgtgctcggttcccacggacagcctgaccgtgttcggcctgatgccggaagcctccagctcttcgggcgtcatctgggagtgcgtggtactggccggatggataaccagtgatttcacatctgcaacattggcgagcagagagaatatctccaggttatcaatgaatttcttcgtatcttccccagtgccgtttatttcaaatgtaaagattgaagcacctccattggggaaatatttctgatacagttcatgatatggactgttctgcacggacggatgattcactttcaatacttttgggtgtgcctgcagaaattctacgaccttcaccgtattctccacatggcgctccacccggagagacaatgtctccagcccctgcaaaaataaaaatgcatggagcggcgccatcgttgccccggtgtcccgcagaatcaccgcccgtattctcgttacaaatgctgcagcccctgccgcctcataaaagcgtacaccatgataacttggatccggttctgtcagctgcggatatttaccggatgcgttccagtcaaagttcccgctttctataatgactccgcccaaagcggtcccatgtcctccgataaacttagttgcagagtgaacaacaatatctgcaccgtattcaaagggcctcagcaggtatggcgtggcaaatgtactgtccactaccaggacgatatgatatctgtgggcaatatcggcgatctcctgtatatcgaccagatttgcattcgggttcccaatagattctataaatattgcttttgtattctcctgaatcgctgcttccactgcgccttctacttccggatccacaaaagttgtggtaatgccctgatccggaagcgtatgttccaacaggttatagcttcccccataaatatattttgaggctacaatatggtctccctgtttagcaagattctgaaatgtgtaagtaattgccgccgcaccggatgcaacaccgagtgccgccgatccgccctccagcgccgcgatccgtttctcaaagacatcctgggtgctgttcgtcagccttccgtatatatttcctgcatcagcgagtccaaaacgctgagccgcatgctcacagtccctgaatacataggacgtggtctggtaaatgggaaccgccctggcgtctgttgccggatccggctgttcctgtcctacgtgtaactgtaatgtctcaaatcttaattttctgtctctgctcatttgcgttgtcctcactttcctgtcaattcacctttacatgcttcctttaaaactgtctgaattaaatatagtacatattcgtactgcaatccagattctctctgtactcccgcaccagctgggccagcgtccgtttactgaggaattcgttcaccttactgtcaatctcatcccacacaagttcctgtatggctttctgtacaggatccgcggcctcctccccattcctgtcgataatggaaaattccccttccaaagcctccagtatctccttcactgtaatgcactcggcgctcttggccagcttatatcctccgccggcccctttcacactgacaacaatgcctgcttttctcaaaactccaaagacctgctccagataatttaaagaaatattctgccgctttgccgtctggatcagggaaatcggaccctcctgtgaattcgctgccatatccacaagtgcacggagtccgtatcttccttttgtagataccttcatataacaccttctttctatatcctactattttgatatgtattgtatatttaatgttatacacccatattcctaccatgtcaatacaaattttaaaactggattttatacgcttgggggacgccttgcgtggaacggggcgggggcagacagaagcataccgctgtttggatactgagcgctgcgctaagcagcagtagatgttttccaaacagcggtatgcttctgtctgcccccgccccgttccacgcatagctaggttcatccaaacggcaggaaaaattagtttcccggcgggattctaaaccaagggcggcggatgtgcagtggctgcgctgtacgtggtcagggttttaaaccaaccttacaggcaggacagcctgccgtttatagtttgcttgacgtccccttcatttccgctgcccggatgatatccgctattgtaaccctgcctaccgcatcattcatcgtcttccacatttcttcccaagtatttctggttgggcacaatccgcaggctatgccgcaattgctctctctggtaaggcagtgcaccggagccagttccccctctactgccgtcagtacctccagcacggtcagttcttcggcatctctttccaggcagtatcctccgtaagcgccacgaacactctttacgattcccttttctttcatgggctttactatccgctccagatatttctcagacaacttccgtctttctgctatattcttcagactctcaagatgatccctgctggaatgcagcgcaagatctgccacaatctccagcgcatactgtcccttcgtcgacattttcattttaagctacactcctttgttttacttacaatatgtattttaaacaaaactcgcataaaaaacaatcttacttttcaaacaatcacgcagttcacagataatccgtaatttttcgacactttttgtatatttttatggattttttcacaaacacattgactttcattgttaaatatgctacgctaatacagcgttgttcagaatagaaatgagcattgcgaacactttattatttatttttttatttatggagggcaacacaatgacaggtacagtaaaatggtttaacaaccaaaaaggctatggattcatctctgactcagagggaaatgacgtattcgtacactactcaggattaatgatggatggattcaaatccttagaagaaggccaggcagttgaattcgatgtaacagacggcgcaaaaggaccacaggcagtcaacgtagtaaaactttaatcagaattttaaatgtaccttttaatatataaattagatttaatatttaaaagaaatacagagaaatgagattaaaaaaagagtgcccggatattccgggtgctttttttgtgtattggaaggggacgccagcgaacaggaggcggacttgaataaagcggattggattgaactggatacccggaacacatcgtatttagtagtttttctgcagcttgccacagatccgcccaaaccaaccaactcaatccgcctcccccgtctgctcccccaccgggtaaggcgctatttaaccgccttaatgcgcccagccccgtttccagacacccctgtgtccggttcccggggcgtccccataccagccaaataccgccctgcctacaagcttacattggaaacgtaagcttccgctgcctcccagacgtcgaatccacttcctcttaatatatcaaccacccttgccgggtcgtcagtttttaataccgccgatgcgtctgtcccatttgcgaatgcatacatgtattcaatattgacttcgccttctacgatttgatgcattgccttgcttaaggatcccgtcgcgtgaggcacccgaagcgccacaacgtctgtcagcatagctgtgattccattgtctttaagcaccgctcttcccttgttcgggtcggatacaatcatgcggagcattccgtaatctgatgtatctgccaggctcagtgcaacgatattcacatcgttgctggccagcactgcaagcacttcgtccagacgtccctcccggttttccaagaatactgataattgttgtattgtgattcccatcgtgcttacctcctctactgcaggttacgcttatctattacacgtactgcttttccttcgcttctctgtattgtcttaggctcaaccagcttcacgcggacggaaactccaagcgcctgtttcagaactgcgccgatctttgctttcagcgcatccagttttctgatctcgtctgagaacatgctctcatcgacctccaccataaccgtcaggacatccagattatcttctctgtccacaatcatgaggtaatgcggtgcaactgcgccgcccatgctgagaagtgctgtctcaacctgcgtcgggaatacgttgacgccgcggatgactttcatatcatctgtacgtcctgtaaacttggatatcctcggtgtcgttctgccgcagtcgcaggtgctgtggtcaatgctggtaagatccttcgtgcggtatcttaaaagcggcatcgcctcttttgccagtgttgtaaataccagttctcctgtctcaccgtctgcacaagcctcgtgagttaccggattgagtacctccggatagaagtaatctacattgatgtgcagacctctatgatggatacagtcctgtgcaactccagggcccgtaatctcacataatccgtaaatatcaaagcagttgatatgcagaatactttcgattttcttacgcatctcttcggtccatggctctgcgccgtgaatcccggccttcagtttcagacggtccacaacaccggcctcctgcagggattccgcaagatgcagtgcataggaaggcgtacatgcgaacgctgtagacccaaaatcttccatacacatcatctgacgtttggtattccccgccgacatagggatcgctgtcgctccaagcgccttagctccaaagtccagacccattccgcctgtaaataaaccgtatccatagcatacatggatgatatcttcctctgtcagtccggccattgtcaggcatctggctacacattcgccccacacatccacatccttctgcgaataggacgccaaagtcagtttccctgtcgttcctgatgtgccctgtacccggacaacatcttttttggggattgccagaagcccgaacggatagttatccctcaggtcttcctttgtcgtaaatggaagtttattaatatcctcgattcctttgatatcacccggttctactccaaggtccttcatcttcttacggtagaaatctacattgttgtatactctttctactacatcagccagacgtctgctctgcagagcagccatctcgtcactgctcatgcattctatatccgggtcaaagatccgctctttccagttttctaaagtcactgccgccattttagtttaactccttatctgttttcccatatttccgtaattttatagatccgcttcttttacgacttttacctccgctgcttccagaacacgcgcagctttttcaaaatcatctgtgttgaacaccataaccggcgcccttccctcgcggattacaaaagaataaatataattgatgttgatcctgccttctgcaagtatggaaagcatccggttcaggtttcctttctcatctttgagttctacaccaattacgtcgtgtatcctgacaacaaaccccttgcttgtcagataggtctttgcttctgccggtttatcaaccaccagcctgagaattccaaattcaggcgtatcaaatgaagcgatcgccctgatattgatatgtgcctccgtcagcgccgatgtcacctgcatcaggctgcccggcctgttttccacaaatactgataactgcttaatcatcctctcaccgcctatcccttataatgtgtatcctacatcaaatgcttttttattgatttcaattgtttttggaggaaccgtcttttcgatcacctcataccactgctcttttgtaaagtccatatgctgtgctgcaacacccagtacaatcagattgaatactttaggattgccaagcttcttggactcttccgtcgcatttaccttatagatcttatactctttttccagggtctccaggatattttccgggtattctgctgcgccgattacaaccggcatcggatcgatgcgccagtcattgacaatcaaaactccgtcctttttcagaaaatgtgcataccgcagggcttccaggcgttcaaatgcaatgattacatctgcctgcccctcttccacgatcggctccgccacctgctcgccatagcgcacaaatgtaacaacactgccgcctctctgtgccatgccgtgtacctcggaaagtttgacatcatagccgcctgcaatggtaagtcctcccaatattctgctggtaagcagggtcccctgaccgcctacacctacaatcataatattctttgtcgccatgattattcacccgcctttaccagttctattgcaccaaatttacatagagattcgcacaggccgcatcccgtacacatagtatcgtcaatatggatggtgccgtctgcatttttcgtcattgcggggcatcccggcttcatgcacataccgcattttttgcatttgtcctcatgcacggtatagagcggctttttggatttgtccagaagtacgcacggcgattttgtgataatgaccgacacttcatctctggcaacttcttccttaattgtcctctccagtgtgtccaggtcaaatgcatttacctcaatcacgtgattcacacccatagcgctgcacagcttcacaatatcaatggcataagtcggatctccctggagtgtttttcctgtcgcagcatgatcctgatgcccggtcattccggtagtggaattatccagaatcatcacggttcctgtcgctttattataaaccatattcatcagggaattcactcctgtatgtaagaatgtggaatcgccgatcacggctacccagtctttgatgtattcctttccctttgccttttccatgccatgcagggtggaaatgctggaacccatgcacatcgttgtatcaactacgcttaagggcgcaaccgctcccagcgtataacatccgatatccccggccgcatgcattttcagcttattcagcacatggtatacgctgcggtgcggacatccgggacataaaatcggcgggcgctgcggggcatctgccgctggctggatatccagctcctcatttaatattgctttgcgcagcatattcgcgctgtactctccctgcacggtaaagatctccttaccgactgccttgatcccccaggacttcacctgctcttcaatgaccggatccagttcttctacaatataaagcgtatctacttttgctgcaaattcctcaatcatcttccttggaagtggattgaccattcccagttttaatacggacgcctgcggaagtgcctcttttacatactgataagggataccgcttgtaatgactcctattttcgtgtcgttcatctccacacggttgatcggcagtgtatttgcggcctcggccagctctttgttgagcctttctatctccacatggcgcagctttgcgttgcccggcatcatcacatttttccggatatttttcacgtaaggtttatcttcgatctcttccctgtcacacagctctaccaggccctgggaatgtgccagcctggttgttattctgtaaataaacggtctgtcaaacttctcacttagttcaaaagctgccttgatatattcttttgcttccgcactgtcagaaggttcgatcaccgggatctgggctgctcttgccaccatcctggtgtcctgctcgttctgggagctgtataaacctggatcatcggcaactgtaagcacaagaccgccgttgacgcccatataggatacggaatacagcggatccgatgccacattcaggccgacgtgtttcatgcaggccatcgcacgcacacctgcgatgctggctcctacggccacctcagcagctactttttcgttcggcgcccattcttcataaaaagtatctttatactgaaccatgtactcactgatctctgtactaggggttcccggataggctgaggaaactttgatgccggcctcatatgcgcctctggcaatcgcctcatttcccagcattatcactttctctgacatagtttatagtccatcctttcgtaaatctttcactctctttgccttgccctcaaatctctgaagcgagttcggggcaaccagcctgatctgtgttgcgagtccaagctgtgacttcagagaagctttgatactctgttccaattcacttaactttgcgtagctgtccagcagtctgtcgtcgatcagctcaacagagattgtcataacgtccaaacggttctttctctcgaccagaatctcgtaatgcggcccgatctcttcaattctcagaaggacttcttctatctggcttgggaatacattgacaccgcggattacaagcatatcatccgcacgtcctgaaagattctccatacgtaccgttgttctgccgcatttgcacggctcatacatcagtttggtaagatctcctgtacggtaacggacaagtggaagcgcttccttgcacaggcaggttattacaagctctccagtctcaccgggagccagcacttcctctgtctcaggattaataatctccggtataaaccagtcttcattgatatgcataccgcataattccgtacattcccctgatacgccgggtccgcacagctcgctcatcccgtagttctgtgtacagacaaactggttgccccagactttatgcatctcatcgcgcatgggttctgtcatcccttcgccgccaaacaggccgatatgtatgttcagatcctttgaagggtcaattccccgctcccttaagatctctccaagatgaagagcataagaaggcgtcgctaccagcagtgtcacacccatatcctgcataaacataatctgcttattcgtattgcctgaagacattggaataacggacgctcccaacttctccagacctccatgcaacccaagtgctccggtaaacgtaccgtatccgaatgcaatctgcgctacatcttctgatgttgcgccgcccatacatgcgattcttgccacattgttcagccagacatccagatcgttcttcgtatatgccactacggttggtttccctgtggttccagagcttgcatggtacctgacaatctccttcttatctaccgcaaaaaggccgtcgggataatgatccctgaagtctgctttatatgtaaacggcatcttctttaagtcttccaggctctgaatatctcctggcttcacaccggcctcatccatcttcttacggtaaggctctaccctttcataaatatatgctgccgttttctgtaaccgttccaattggattttctcaatctcggcccttggcagagtctcttcctttgcccaaatcatcgtaaaaacctccttcaacatcacattcgttatccaatagtataacacactgctttgacgaattaaagcattaaattttaaaaaattatggggaaagagtgctttgcagaatgagcaacgggaggggccggaaagacctgtgctgttttgtagggcgggccgcagacttagcggcagtaagaggaaaaagaaaggattgcagggcccggcaatcctttctttttgggggattagataagcgggtactttttcgtaagttctgctaccattccctgtgctttttctacatttgcttcatcatctataaccatggctatgatttctgctatttttgccatgtcttcttctaccattccccgggtggtgactgctggggttccgagccttactccgcttgttacgaacggagaacggggatcgttcgggatggtgtttttgttgcaggttacgtgggcttcgtctagacgtttttcaagttctttgccgcttaagtcgttctctgtcaggtctacgagcatgaggtggttgtcggttgctccggagacgatcttgacgcctctttcctggaggcctttgcacaatgctttggcgtttttcactacctgttcctggtatgtcttgaactcaggctgcagggcttctttgaagcagactgccttggctgcgatgacgtgcatcagcggtccgccctggattcccgggaagactgccttattgaagttgaactttttattcatctcttcactgcacaggatcataccgccccttggtccgcgcagggtcttatgcgttgtggtggtcgtcacgtgtgcataggggatcgggcttggatgaatgcctgctgccactaaaccggcaatatgcgccatatccaccatcaggtatgcacctacctcatccgcaatctcacggaatctcttgaagtcgatggtcctggcataagcgcttgcaccagcaataatcagctttggtttatgttcttttgcgatttcaagtaccttatcataatcaatgacaccgttgtcattcacgccatacgctgagaaatcaaaatacttgcctgacagattaaccggtgaaccatgagtcagatgtccgccgtgatccaggttcattcccatcactttatcacctggctccaccatagcaaacattgcagccatattagcctgtgctccggaatgaggctgcacgttggcatattcgcactggaacagctcttttgcccgctctctggcaagattctcaacaacatccacacactggcatccgccgtaatatctctttcccggatatccttctgcatatttattcgtcagcgggctgcccatagctgccataacagccttactaacccagttttcagaagcaatcagctcaatatgagaattctgcctgtccatctccgcctgaatcgcttccgcaatctctacatcttcattcttgatttcctcgaaaccgtacataattcttctcctccataaatctttaagcattcccgggacataaaaattccccgataaaagtccattgggaacattatagcataaataagaatggaaagtccatacattattccccgcgctccctacccaaaatcaaatagcgacaactgattactctgcggcaggtctccaaacagccccagttccgccataaaatcaatgactgttttgctgacctttgtccgctgtctgaaatcatccagagacaggtacggcccgtctttagctgcttcctccacagcctccgcggctttctcacccataccttcaatactggagagcggcggcatcagtttcccgtctataatctggaatttggttgcctttgccctatagatatccagaggcaggaactcatagcctctggcatacatttcctgcacgatcttcatgtcttttactacatcctgctctttattgctcagcgaatccgccctgcgtttgtagtcttttatataataattcagcttgtctttcccctggcacatgatttcataagaaaatgcattggcgcggataccaaaataagcgccataatacgccagcggataattaatcttgcagtacgcgatgcggtaagccatcataacgtacgccgccgcatgggccttcgggaacatgtagctgatctgtttacaggaccagatgtaccagtccggcacgttcttctccttcatggcttcttcccattctggtttcagcccttttcccttacgcacactctccatgattgtaaaggacagcgcgctgtccacaccctggttgatcaggtagatcatgatatcatcacgtgtacagatacaggtggaaatcgtggcctttcctgattttaccagttcctgtgcatttcccagccacacatttgtcccgtgggacagacccgatatacggatcaggtctgaaagtgactgcggcttcgcatcctgtaccatctgaataacgaagtctgtcccgaactcaggaatcccaaggcatcccaggttgcacccgtctatatcctccggtttgatccccaaagcacttgtatcgtggaacagggagagcaccttcttatcgtccagcggtatattggtggcgataaacggattctcctcattgtactcattgtccatggcatccgatgtgatatattcctctagtgtacggatcatggtcggatcatcatggccgagaatgtccagcttcaaaaggttatggtcaatggaatgataatcaaagtgggtcgttatgatatctgttgtcatatcgtttgccggatgctgcaccggggtaaactcattgatgctgtgtccgtgaggcagtacgacgatccctcccggatgctggcccgtacttctgcgaatccctgtgcatcccaccgtaattctgtcaatctcacactttctttttctgtgcccgcgttcctcgtaatagttccttacataaccaaaagcggtcttatctgcaagtgttccgatagtcccggccttaaacgtatggccttccccgaatagcacttccgtatacttatgtgcctttgcctgataatctcccgagaagttcaggtcaatatcaggctctttatcgcccttaaagccgaggaaggtctcgaatgggatgtcaaatcccgccttaatcagcatttccccgcagttcgggcatatcttgtccggcatatcgaagccgcagccccctgcgtatgcctttacttccggggagtcaaattcattatagtggcatttctcacagtaataatgcggacttaagggatttacctcagtgatccctgacatcgtggcaacaaaggaagaaccaacagaaccacgggaacctaccaggtatccgtcgtcatttgatttccataccagcttctgggcaatgatatacatgacggagtacccgttcgatatgatagagttcagttccttctccagacgggtggataccggctccggcaggtcttcgccatagatttcatgagccctgttgtaacagatattcctcagatcctgctccgaatttgcgatcaccggcggacacttattcggattgatcggagatattttctcaaccatatcgcagatcttgttcgtattctctatgacaatctctctggcctttgctgaacccagatattcaaactcttccagcatctcctccgttgtccgcagatacagcggcgcttgttcatcagcatcactgaatcccttacctgccatgataatccgacggtacacctcgtcctccggatccaggaagtgcacgtcgcaggtacctacaaccggctttttgaacttttctcccagttccacaatctttctgttaatctcctctaagtcctccgtagtgttgatatccggaaacttgtcactgaccatcataaaccggttgttgccgagtggctggatttcgtagtaatcatagaaatctgcaagtcttgcgatggactctgcagacttattgttcaagacagcctggtacagttctccagcctcgcatgcgctccccacgatcagcccctccctgtacctgttcagcacacttttggggatccttggccttcttgcatagtaggtcaaatgggactcggtaatcagctggtaaaggttataccggccgatatcattttttatcagtatgatgatatgataggtgggcagtttgcggatggcattcggattcatgtctccaaactggttcatttcctttaaggttgtgatattttgttctttcagcatctggacaaactttacgaatatctccgctgtagcggcagcgtcgtctaccgcccggtggtggttctccagggagatccccagtgccttcgccaccacgttcagcttatacttggacagtgtaggcagaagtaccctcgccatagccaccgtatccacataaacaaagtccggctctatatcctgatatctgcaattctgctcgataaatcccacatcaaaccccgcattgtgcgcaacaagcaccccatccgccgcaaattccagaaactgcggcaatatcgtctcgatatccggatatcccatcaccatttcatccgtaatgcttgtgagctgtgtgatctcaaacgggatcggccttttgggattgacaaaggtgctgaaccgttccacaatctctccatttacaaccttaactgctccgatctcaattattttatctttaatagcgctaaaacccgtcgtctccagatcgaatacgatatatgtatcatccagccgctcatccccggcattcaccgcgatctccgtcagatcatctacaacatagccttccacaccataaatcactttaaaaggatcgtccttatcaagtgtctcgataaaatgattggcatccgggaacgactgcacaataccatggtctgtaatggcaacggcgggatgcccccagtcatgggcacgcttcacaatatcctttacctcagaaaccccgtccatatcgctcatctttgtgtgacagtggagctccactctcttaacctggctcagatcctttcttgtaacggtaaaatctccgctctttttgatgcctgtcactgagccgatggtcagttccccgtcaaatttatcaatggttgtaatccccttgattttaacgaaaacacccttttttaaatcccccagcagctccggcagctgatcatttctggtgaacatcttcaccgtaatcgtatcggtaaaatccgtgactgcaaacatcagaatcgtcttgtcatttctgatctctctggtgtcaaaattaatgatctttccgtggacggtaatctctcccatctcggtaacaacctgatccagtgtgatcggctcatcatcgaaattcctgccgtatatcagactcgggtcatcgccttgcttaagcggcctgtagaaatcttttttcttgaaatctttcttcttgaaatcgcctttcttcccggagtctccccgtttttcctggttcccctcctttttttctctctggccgccaacgctgtcctctgccggttcttcgcctctctgctttgccctgcgttcaaatatggcattgatctcctgctggatcctctgctcttcatactgacggtcctgctctccctgcgcctcgcggtacgttaccctgatgtcggctttgatatggaatctcttttcatagatttcatgaagcagatctacgatatactcccgttttccttcggatacgatcgtattgagcatctccagatacaggatatcactgccttcaaagtgcatctctgcctgttcaaacatacttgccgccagcacgctgtgctgcttcagttcctgcacaatgctttcccggtattccatcatgagcgtgctcgccgtgtactgctcggacaacgcatactgctcttccaggcggatggacaccctcgtattgccaaaaagctgctctttaatcttctgttccatctgccatatatgctttttctggatcagatgcctgctgaaaatgtggacacggagaaaatcacgttttgagttcgttgtgatcttcgagacctccacatcgctaaaaagcatcttgatatcattttccacttttaatgttggaaaaacatgaaaaaatatcttttcgttccctatcttttccaatttaacaactcctgccgcaaggtttccagaagctcctcttccttcacctttttcacaatttcacctttcctgatcagaaggccttctccaattccccctgcaattccgatatctgcctcttttgcctcacccgggccgttaacgacacatcccataacggcaaccttgatatccagagggatatctgccaccatattctcaacctggtttgcaaggccgatcaggtcaatcttcgtccgaccgcaggtcgggcaggacaccacttcgatcccgcctttgcgcagccccagtgtcttcaatatcagctttgcagttttaatctcttccagtggatctccggtcaaagagacacggatggtatcgccgatgccttcgtacaggatgattcccagtcctacagaagatttgacatttcccgagtaaacagttcctgcctcagtgatccccacatggagcgggtaaggacacctcgaagcgatctgttcgtgggccttcacacacatcattacatcagaagatttgatactgaccacaaggttatcatactccatctcttcgatcattcggatcttgtacagcgcactctccacgatcccctcagcggtcacgccgccgtacttctccagcaatggtttttccagcgaaccgctgttgacgcccacccggatcggcgtctcatattcctttgcctttttcacgacggcctgcagacgttccctgctcccgatattaccagggttgatccggatcttatctgctccgttctcgatcgccgcaattgcaagcctgtaatcaaaatgaatgtctgcaaccagtgggatatggatctgcctcttaatctcttttaaggcataagccgcctccatcgttggtactgcgcaacggatgatctcgcagcctgccgcctccagctttcgtatctgtgctgctgtagactccacatcctcggttcttgtattcgtcatagactggattgcaaccgtatgaccgcctccaataaggacatctcctattctgactgtttttgtcttttctcttaacatctccatcgtaattatcctttctgcacacaccgtcttatcgtagaaaaacagggagtgaattccctgttttccggttactttttatcaaatatcatctgatctccatactctctgtcggtcagtgtcagtgtacttttttcaatgttgtagtcatacgttccctccagcgaattcactgccgaacttaatccttctgctgtagcagttccgtccgatgcatccgctgccttttgtactgcctcgtcatccgaccgcagtgtaaatgtctttgtatctttgtcaacactatacctcatctcaacagagacgccttcgctctcgaactcttccggccattcaagtactgcggtcccattccccctgatcgacataaccaggccgctgtcctcatgactccacttgccttccactggattggcagtaaaaagctttatcacgaaaaaggctgctatgatgatgatcagcacagttgtcacagccattacagccctccagatccggtttcttttttcttcgttattctttgcgatcatgcatatacttcccttctttttctcaatttcattatacgaattttaccggtctgtgtcaacgggtatcacttttgcagcaatttgttcagtaatcaatacgtgtcatattgacacttttgtttttcttatgttgatttttgacacaatttgtctataaattgtaacaagctggtaaaatataccatattctgggaggtgccattatgaagtttgcatctacattgaaactactaagggaacaaaatcatgtcacgcagaaggaactggctgattatctgaaagtgacacgctccacaatcgcaggctatgagacgaagggcaaacagccggattatgaacgtttgctgcgcatcgccgcatacttcggcgtatcggccgattatctgctgacgggttcgaagctagggattatcacaaccgccagtactgcacctgaaagggggcgtgagatcctgatttcttatcttcatctttccgcggaatcccaacggaaactggaagaatatctgcatctgctgatgctgaaagaacaaaatgagggaaaaggacagatggaagcgggatcctaaaccaaaccggaagtcaaaatatgtatttctgacagctctgtttcctgtctcaatacacattttggcttccggttttctatctggtgatttgaaacctgtcacttcctcatttatggggatgcttctataaactatcgtaacagttcaggcaagcctgaactgttacaaattatcttatataacttttcagaaatgtgaaaagtgcttccatctcttctctggttcctactgtgattcgcagatactgctcgatccgttcgctgccccagtaccttacataaatattttcttttttcagagcagcaaacagttttgctgcatcataatccgggtgagcagcaaatataaaattagcttttgcgtcgggaaactgaaagcccagactactcagctctttcttggcccactctctggtttctatgatacttgctgtcgtcttaccaaaatacactttatcttttactgcttctgtcccgcatacaagcgacggaagattcatggtataagaattgaatgaatacttcacatcatccaggtatttaatcaaagccgggctgctgatggcatatccgattcgcatccccgccatagatctcgcttttgaaaatgtctgcactacgatcaggttctcgtacctgtttaaaagtttcagcgcagatcttcctgcaaaatcaatgtatgcctcatctacgatcacaatcacttcctgattatgctttagaatatcctcaacaaactccagatcctcataaacggccgtaggagcatttggattggggaatataatccctccgttttccttatagtaatcttcccttcggatacgaaaatcttcatccagtttcgggcactcataagggatgtgataaagctcagcccatactttataaaacgaatatgtaatatccggaaacaaaatcggcttttttgaattgaaaaatgtcaaaaaacacattgacagtacatcatcagagccaactccaacaaatacttgttcacggctaacaccgtaatactctgccagtgcctccacaagtgtgcccgaggcagggtccggataaagacgcagacggtctgtgtccagatgcttcaacgcttcaagcacccccggcgccggtggatagggattttcatttgtattaagcttgattaccttttcctgtggctgttcaccgggaacataaggctctactttacgtatattttctaacaactttgcatttggttccattttcgctgctcctgtcctatctgtattctgccgccagttccgcaaatttaggcagagaattcacgattgtctcataggatacacaatatgccagcctgacatagccagggcatgcgaatgaggagccgggcacaatcaaaatattatactttttcgctgcggcacagaattctttttcatctgcaaccggtgattttacaaacagataaaaagcgccttccggtttgatacattcaaagcctaattcttttaaaccgttatataatgtttctctgtttctattgtaataagaaatatctgtcttttcgttcagacatttcttaaccaccttctgctgcagggtaggcgcatttacaaagcccagaattctggtcgccacatttgctgctccgatcagcttttcactgtcagccgcctcatccggaattaccagataaccgatgcgctcccctggaagggagagggatttgctgtaggaatatcctacaaccgtattggcataatactttgtaagatacggaacttctactccgtcatatgccagttctctatatggctcgtcggaaatcagataaatctccgtcccatattctttttgcttttcatccatgacagcggccatcttacgaatggtatcctccgaatagacaacgccggtcgggttgttcggagtatttacaatgacagcctttgtcttcggcgtgattttggcttcaaattcatccagttttggctggaatgtggaggtatccggagaaatctccacaagcactccgtcataattattcgtataactcctgtattcgccgaaataaggggcgaacgcaatgacctcgtctccggggttcagaagcgatttgagaatgacattcaggccgcctgccgcaccaaccgtcattgtaatattcttagattcaaaatatgtaccaaatcttttatttaaagattctgcaatggcctgtcttacatcctcgtagcctgcattactgtttgtatatccatgaagcacaacggggttttcttcatcaagcagctcgcggatcgcgtcctttaccgcctccggcgcgggaacattgggattgcccaggctgaaatcatatatattctccgctccgtaaatccccgccagacggttgccttcttcaaacattgcgcggatcgcagaactgttcgcgaccatagtttccattttttttgaaatcattttcctctctccatttctgatttatttaatatatggacatccggggatacccttctgacagttctgcggaatagccgcagaactgaattcgctattcggtaccgcgggccgtctttttagtaacaacccctttttctaccagaaaggccggcctgtacgaaagttttgccttcctcagcccttccgcccccgtatcctcctcgcggttcacatatttataatccatgcattcgtgcagcacaaactgctggttaatcatcggatatgcaccgtcaatatcagcaaatgccttttctatatgaacaacaaacgtatccccgcatacaggttcgccaatcgtaaatgcggcaatctctccgttcaccctgagaacaccgcccctctgcccaagttccttaaacaaacgcagcgaattcagtgtcacgcacatctccgcattcttatcggaatcctcctcacacccattctggttacgccatttcaatgccatctggaaacactcttcctggttactgtcatccagcgtctcatagctccagtccggattcgccgtcttaaacttattaatgtggtttcgtttgctgtgaagcttcttgcctgccaacgtcgctaacttttccgtttcatacacataatccgcttgatcccgttcatactcaatctggtattcaccgggataccagcgatccaactgcgcaaaattttcttccgtcacgttatatagtttaaacggatatcccttctccacgctgtatttcataagaaattccagtgcatttttaacgcactgtggttctcccgccggataagcaaacgcaagatcaaattcatcgtcctgaaatatcagggcatcctctataacagcatacttaacatgataatgcctggaccagaggtacacgttactgaatgtcctttcgcagctcctgctaggtgccttataaaaataagaagtaatgatctccctgtcctccagctccggccgtttaaaatttatatcgtccattcctatccttctctttctgaatgtaattactaataaccttttgtataaacttgtctcacagacaaataatactttgatagtataccacattttttctttaactgacaataaaagcatagatatttaaaaaaatgagatttagagagctttagtcccggcgcggaaggggacgcttaatgaaagggatgccggggagggactagggttgtatatgggagagaattggtggttcgtttatatcggcaaaacttttttgagtgcttttatatctttgaccacactggtctgtaagacttttcagtgaaagccccccttctccttcaaaacttatcggggctataaaagtccctccaatccaatgccatacgccgccccctttgaggcctcctaaggaatgagccttttcgtaccgcccggatgcgccatccctttatggagcgtccccacccgtcaatgaggctaaggctcgtcccttaattcccgaactgcatttggtacagccccgcatatatcccccgttttctcagcaattcttcatgtgtcccttcttctgcaatcccatgatccgccatgaccagtatacgctgtgcattgcggatcgtagacagcctgtgcgcaatcacaaaggtggttctgttttttgccagattctccattgactgctgtactactttttcactttcattgtctagcgcagaggttgcttcgtcaaagatcagcacttcaggattcctaaggaagactctggcaatggaaaggcgctgtttttgccctcctgacagttttacgccccgctgtccgatatctgtatcgtaaccttcgggaaaactcatgataaactcgtgggcattggcatttttggccgcacgtaccacttcttcgtccgtagccccgggttttccgtaacggatattatccatcacactgcccgaaaacagatagacatcctgctgtacgattccgatatgactgcgtagttcttccaatttgatatgcctgatgtccgttccatccagaaggatcccgccctcagatacttcatagaaacgggggatcaggctgcaaagcgttgtcttacccactcccgacggtcctaccagtgctatatagtcgcctgcctccactttgagatccagattgtccagaactttctcactctcattttcatagtaaaaggatacttttttaaactcaatggtgccttttacgtctttcaaggaaaccgcatcaggctcatcggcaatatccggagctatagacaggatttccagaaatctctcgaaaccggaatagccgttctggaattgctcggtgaagttcaccagtttccttactggttccgtaaaattattaatataaagcagaaatgtaatcagatccgtcacggcaatcgagccattgagcatcaggctcacgccagccagcagtacgacaacagtaatcagagtactcattgccccaagcccggaattataaattcccatgtacttatagctcagcttctttgccgccacaaaattctcattccctgccttgaattttttcatttccatattttcatttgcaaatgattttacgacacggatacccgaaagactgtcttcaatctggctgtttatgtctgcaatcttctctcggtttcttttgaatgcagttttcattttaccgttataataaaaggcgaatatcgccataaccggaataaatataaaagcgatcaaagccagttttacattaacagtcagcagaatcacaaaggaaccgattattttaataatagatatcacaaggtcctccggtccgtggtgaagcagctcactgatatcgaacaggtcgcttgtaattctggagagcaggtggccgaccttctgattatcataaaacgcaaatgtcagcttctgataatggccgaatatatcgctgcgcatatcggcttccatctttgcgcccatcgtatgtccgaagtacgctatgtaaaaattgcagaaaacttccagtgccacaagcgccagcatcacagcacccagaaccagaattgcatgtctcgcatcggccctgtcaaaataaataacgtcgtttgtaatataccggacaatcatcggaatgaccagggtcacagccgctccaagtatggcaaaaaacatgtcgctgtaaaacagccctttgtagggcttataataggaaaataatctcttcagtttttctttcatggtcttacctctctcattataacaattcgtatgttaatcatattactccagttccttcgtatctgtaaacccttcatttatatatccatgcttcaatacagttatacggccctgcatccgcagtatctacgccctcaggcttttcgtgatacaggaacttcctaaatcataaaatcttaataaaatccccaaagtattttaagaagaagctgaaataatgaaactaacgtaacaaatcaggcaggcctgtctgaaccgttacaaactaatgcatcgaaaatttaggtcagtataacagtaagttaattattttcgatgtacaagcatcaaggaggaaaccgctatggctgatattattattacgctctatcctattttatgtgtgctgctgccctgtcttatctatatgtttatccgggcccgcaagcccggaaaacatctgactaaggctcattttatctgggtattcctgtttgtgttctacctccatatggtactggacacaacagggatcggaaccatatgggacatcggcaaatacgacagcatcctttcactggataagatcaacctgattccatttaacgatgggctggagctttcacagattttgaatatcatcatgttcatgccacttggatttctcctgccgctgctctggagcaattaccgtacactccctagagtccttctggccggagccggctattctctttccatcgaaatctgccagttatttaacaacagggttaccgatattaatgacctgatcatgaacaccttcggcgcactggccggctattgcatctggatcgtataccggcgcctgtttccccggaccggcacgagaaaagagctcgcactctccgcccacgagcctgcggtttatatggtgctgagcgtacttgccgtgttcttcctgtgcaactggaggtggatggtatataagttgtatatgtaacagagcatacacataagaaacctttttcaatctgtactaaagttttctgacggcgcacaactataagagtccggcatcagcttttaccgctgatgccggactctgattaatcctgcttagttatcattcatattagccagttttgccgcctggtctgcagcggtcagactatctatgatttcatccaggtccccgtttagaatcgtatccagtttgtgcagcgtcagcttaattctgtgatccgtaacccgtccctgggggaagttgtaggttctgatcttctcagaacggtccccggttccgacctggcttcttctcgcctcagcctcggacgcctgctgcctttccagttccaggtcatacagcttggagcgaagcagccggaacgccttttccttgttctgcagctgtgacttttcggtctggctgtaaatcacgatccccgttggataatgagtcagacgtacagcggagtccgttgtattgacgcactgtccgccgtttcctgacgcacgcataacgtcgattcggatatccttttcctcaatgacaacgtccacttcctcggcctccggcataatggcaaccgtaattgtggaggtgtggattctgccgccgctctctgtctccggcacacgctgtacacggtgtacgccgctctcatatttcaaacgggagtatgcgccctgcccgctgatcataaacacacactccttgaaaccgccgattccgttttcattcagggaaatcatctccactctccagcggcgtccttctgcataatgaacatacatacgatagatctctgccgcaaacagcgccgcctcatctccgccggctcctgcacggatctctacgattacattcttttcgtcattgggatccttcggaagcagcaagatcttcagttcctgctcgagctcttcaacccgggctttggaatcattgagttcctcttttgcgagttcccgcatctcctcatcagattcttcatccagcatgatcaggctgtcctctatgttctgcttacactgcttatattctttgtatgcctctacgatcggagtcaggtcactctgctctttcatcagtttccgaaatcgttccggatcattagccacatccggctcctgcagttctcccattacttcctcgtagcggatcagcaaatcttctaatctgtcaaacatatttctctatcctttctcacaactcacttcattcatcatacacgcccgaaacgacccggtcaagtcctggcagatccttttttacggcaacatgggtatagcccgcctcacacatcatggattgcacggcctcaccctgatcggccccgatttcaaacagaagacatccgccgcttacgagaaagcgccttgccttgtccacaatctctctgtaaaaatacaagccgtcctctttgccgtccaacgccagaagaggatcatgctgcctcacttcttcctgcagggtctttatcacatcggttctgatatagggcggattggacacgatcatctggtaggttccctccaccttgtcaaatagatcgctgtgcaggaaatctgcgcggatatggagcgactctgcattctccctggctgtttccaatgctttctccgagacatccgtccctgttccttggatccgcatcttctcttcttttctaatctcatgcagaatactcagcaggatacatccggaaccggtacacatatcgagaagacggaatattttttcattcttcccgcagatgtttccggcgagcgcaccgcatgacttttctttatatttatgaataaaccggatggcttcctccaccaaagtttccgtatcctgtctcggaatcagcacatgttcattcacccggaattccaggcccataaattcctgcgttcccgtcagatgctgcagggggatcctctgcgcccttttttctacaaatcctatatactgcttttcctgtacctcggtcagaattttatccggcatggtataatacatggccctgctgacaccgctcacatgttccagaagataccaagcatccaggcgggcatctgtgattccggcctctgttaacaacacttctcccctttgatacgcttcacgcagtgtcataactgctgccctttggctgcggcccggcccgtcatatcatattgtccggccgtctgcccggatgccacaacggttttcgttacttgatccagtgtcttctcatctggcgtgcctgccggcagctgggtaccgaaattctccgccagatatgccttccagtcaaatacggcttccactgcacaaatcgccacttcaatcatgctgtcatccggctctttcgtggtcagattctgcacccacattcccggcttgctcagcaggttgatgaaatagttatcactgtttccggccagtttgataatctcatatgatacccctgcgatcagcgggagaagcgcgatacgcagcacaactctcataacctgtgactctgctgtaataaagaagcagaatataatactcactatcatgacaaagaacagaaagcttgtgccgcagcgtttatgctgcttggagcttttccttacgttgtctgtattcagaatgagcccatgttcaatacaattgatgcacttatgttctgcgccatgatacataaatgttctctggatatcttccatcctggagacgagcagaatatatcccagaaaaatggccaggcggatcacgccttccagaatggtgattacccctctagatgcaatgtgcttccgcagtatattgctcaaaaaataaggaagaaccataaatatggcaaccgcaagaactacggaaaatgcaaccgtcagattcataaacagtttatcctgcttctccttctttgcaattgcttcctctgtcagctccacctctgtctcttcttcctcttcaaaaaagctcgccgaaaacatcagtgtcttcatccccaggacaagggaatctacaaaattgaagataccccgtataaaaggaatcttcatcagcggcttacatggaattacactcttgtactcctgtatatctaccgcgatctctttatcaggtttcctgaccgccaccgcatactgattaccattcttcatcatgatgccttccaaaactgcctgtccgcctatgttcgatgacttcatgcgtcctcctgtcttctgtaccagaaaagggtcagttccttcttcatccgaagttgctgaccttctgatcaaatctgcatatatagttacttgtaaggaactgcccggaaatcacttgcgcaatttgctgagcaaagtgatcatgtgattacggacagtcctttacccaagaacaggctgagatatctcacctcagcctgcaataagtcattcctatttaataccatattttttgttgaacttgtcaacacgtccgcgagcctgatttgctttctgctgtccagtgtagaatggatggcatttggaacagatttccacgtgaatattcttgtttgttgagcctgttacaaatgtgttgccgcagttgcaagttactgtcgcctgatggtactctggatggattccttctctcatgattttcacctctctattttaatatatagtcattataatctctaaacagctttgttattgtatcataagatttatggttttgcaagctatttttcagaataaacaaataaaataggacaagtcttttttgtatatccggtttgtgatataattcccatgtttgatttatcattaatgacataaggagttgctcatatggatatcactaccccaattatcgaactttccgcttccacatttctaatcgtatgcccctttctttttcttgccgggctggtagatgcaatcggaggcggcggtggcctgatctctctgcccgcctatcttatcgcgggacttcctcctcatatggcggttgccaccaataagatgtcttccacctgcggaaccacgcttgccacaatacgttttatgaaaaacgggcttgtcagcttccggctggccattccttccgtgattgccgcaattgcgggctcttcaatcggtgcacatatttccatgatcgtaccggagaagatcatgctgtatgtactcattggtatactgccagtatctgcattcctggtgctgaataaaaagctgttccatgataaaggaagcgattctgttacgctggacaaaagaacttacataaccgcagtcattgctgcttttatcatcggtatctatgacggattctatgggccgggtacgggtacgtttctgatcatcgcttttaccgtatttgctaagctcagtattaaaaccgccaacgcacaggcaaaagtaattaatctgacaacgaatattacatccctcattatctttctgctaaatggccaggtactgatccccgttgggatcgcagccgcactgtgcaatatggccggcggctacctgggtgcaggaatggttatgaaaaatggcgctaaaatcgtaaaaccaagcattctgctagtgcttttcctattgcttctgaaggtactcaatgtatactagaactgcgctgcgtaaattcctttgatatggtattcgctgtcaggaccagcgtatccttatgccattgctatagaaatttctttttgatcacaacctggacaagatctgcattgctctttgtctgtgagaacatattcagcaggttgtccacggcttcttccgctttcaggccgttcattgccctgcggataatatagactgcatcctgttcctctctgctgagcaggaggtcttcccttctggttcctgattttggtatgtctatcgccgggaataccctcttctcctggagttttcgatccagcaccagttccatattgccggttcccttgaattcctcgtataccacatcgtccatcttgctccctgtttccacaagtgcagtagccaggatcgtaaggctgccgccttctctcatatttctggctgcaccgaaaaaccgcttcggcatatgaagcgctgccggatcaagaccgccggaaagtgttctccctgatggaggaaccgtcagattgtatgcacgggcaagccttgtaatactgtccagaaggatcgtaacatccttgccatgctcaaccagcctttttgcgcgctcaatcaccatctcggatacccttttatgatgctccggaagttcatcaaatgtagaataaatgacttctacattcggtcctgcgatcgcctcacggatatctgttacttcctccgggcgctcatcaatgagcagaatcagcagatgcatattcggctcacgcttttgtacagagagcgccacttccttcagcagggtcgtctttccggccttcgggggtgacacgatcatccccctctgcccttttcctataggagaaagcagatctacgatacgcatagctgtagaacatcccggtgtctccaggcgcagcctctgattcgggaagatcggagtcaggtcctcaaaattatttctcttcattgcctccgacggcctcataccattgatggtggaaacatacaaaagggcgctgaacttctcagactgtgtcttaattcgtgtatttccggaaatgatatcaccggttttcagattaaatctcctgatctgtgaaggggatacgtaaacatcgttttctcccggcaggtagttctcgcatcggataaatccgtatccgtccggcagaacctccagaatcccgttggctgacttaccgctgtccagctgttcaatatccgtgccttccttcttttctttcaattcttcttttacttcttccttggcttctgcccttgcttcttccatcttctctttctcatcctgagccagcatagcgtcaatcagcccgctttttttcatagctgatacacctttcatttttcgtgcttttgccaggtcttttaatgttgcaagcggcagagattcatatttttctctcgtcataatactttaattcctttctcaataaatatatggcttttctacagtattcttttgtttcaatccacgtccgataatttcacagagtacgtgtacatccaatacagatgcgtagattgatctcatgccagtgggagatagtgactcctctcctgcccaaactgtcgttaatcttgtttttcatgattcatctcaccgtctatagcggcgggaaaatcctcatcttatcttgttaaattttacgggagcctttagtctgaaacgacttgtccgaattcaggcgtctgcctgtatcctcaaagatatactattcctatccgcactcggtaattctatagagtacgactgcatcttccatcgatgcgtagattcatctcatgtcagtgggggataccgattcctctccacccaacactgccgttaatcttgtttcctgtgattcatcaatccacttataaagggaatgaatcctcacttgacttgttaaatctgtagctattatacatcatcttccaccaaaaagaaagagtttttttagagggcttgcggctaacacttcatggaacgtcccagtccgccaacgagactaaatctcgttactatagcaatcctgccttgcgttgcttttataagagtgttattatattggacagatagcaagaatctataagaatatgaagatacagcgaggtaagaaagatgacaaacagtgaaaaagcattgcagatgcacgaaaaatggcagggtaagatcgagactacggctaaggcccatgtgaactcccgcgaggatcttgccattgcctatactcctggtgttgcagaaccctgtaaggcaatcgcagaggatccggaagatgcttataaatacacgataaaatctaatacgattgcagttgtctccgatggaagtgcggttcttggactcggcaatatcggcgccctggctgcaatgcctgttatggagggaaaggccgttctttttaaggaatttggcggtgtcaatgcggttccgatctgtcttgatacccaggataccgaagagatcattaagactgtagttcacattgctcccgcatttggcggcatcaatctggaagatatcgcggccccgcgctgcttcgagatcgaggagcgtttaaaagagctgctggatatccctgttttccatgatgaccagcacgggacggctatcgttgtcctggccggtattatcaatgcgctgaaagtcaccggaaaggtcaaagaagaatgccgcgtggtgattaacggtgcgggatccgccggtgttgctatcaccaggcttttacttacatatggtttccgtcatgttaccatgtgtgatatcaatggtatgataagcaaggcctcccctgatctgaactggatgcagcaaaagatggcagaggttacgaatctggaaggacggacaggtacgctggccgatgcgcttcagggtgcagatatatttgtaggtgtctctgcacctaatattgtgacaaaagagatggtgtcctctatgaataaggacgcaattctttttgcaatggcgaacccggtaccggagatcatgccggatcttgcaaaggaagccggtgcaaaagtcgttgggaccggacgttcagattttccgaaccaggtgaataatgtggtagctttcccgggtatatttaagggtgccctggaggggcgcgcgtcccagattacggaggatatgaagctggctactgccaaggcaatcgccgggcttgttgcggaggaagacctgaatgaaaacaatatcctgccggaagcttttgatccgcgcgtagccgaggcggtgagcaaggcagtaaaggaactgatatagatgatgcgctggggggaaaagcgttaccactccatggactatgacctgaaacaggcctatggagagaaggtatataagatcaccctggacggcggcatgacctgcccgaaccgggacggcactttagggcacggaggctgtatcttctgcagcgccgagggctccggagacttcgccggctcaagagcctgctccgtcacagagcagattgccgccggaaagcaggccctgaatgggaaacgtccggttcactcttatatcgcatactttcaggcatttaccaatacctatgctccggtacgccgtctggaagagctgtacatgcaggccattgcagatcctgatgtccgaattctttctattgccactaggcccgactgtctgggccctgacgtcctggaactgttagacagaatcaaccggatcaaaccagtatgggtggaactggggcttcagacaatccatccagcaactgcagcgtacatccggaggggatatgacctgcctgtctttgaaagtgcagtcggtgctctcagaagcagggacattgtcgtgatcgtccacaccatcctctatctgccaggcgagaccagagagcagatgctggagacactggattatctgaaccacatggatatacagggcataaagctgcagcttctgcatattttaaaaggaacggatcttgccctggaatatgaaaagcatccgttttacgtccccgggatgatggagtatattcaatttttgggcacatgtatctcgcatctcaatccccggatcgcaatacaccgtctgaccggcgacggtcccagcggtcttctggctgctccgctttggagcagcaataaaagaactgtcctgaataccctgcaccgttatctgaaggagcaggacatctggcagggaaaggagtattatgactgaaacatttaccctatataagttaatcgtattatacatgctggagaaagtagattttcctctgaccacatcccagatttcggaattcattctggacaagggttatactacttattttaagctgcaggaaacgctgtcggagatggtggaatccgggctgctccgggtagagaccactcacaaccgtacgctgtaccacctgacggaaaatggagcggagacaatccagttcttcaagaataagatctcaaccgcaatacagaacgatattgatgagtttttaaaagaaaaaaagtatgacctaaaagaagaagttgctatcaaatcagactattacctgaatacaaaccatgaatatgaggtgcgctgccagatcgtggaaaatggcttcagcctgattgatcttaagatcactgtcccgacggagatcgaggccgaaaccattgccagcaactggtcaagggagagccagaagatctattcctcactcctgtctcagcttctctaaatattcacgtatcgttttttcgtatccaaggacgcccggttcatagaatctggcgtcttttatttcgtccggaaggtactgctgctttacgtaatgccccggataatcgtgtgcgtatttgtaccctactccatgccccagcttctgtgaacctttatagtgagcatcctgcagatgggcgggaaccgttgtcttcttctggcggacacattctgttgcagagaaaatggcattggtggcggaattgctctttggtgcggatgcgacataggtcactgcctgcgcgaggatgatctgcgcctccggcatcccgatgcgttctaccgcctgtgctgcagataccgcaaccgtcagcgccatggggtccgcatttcccacatcctccgaggcacaaatcataatccgccgcgcgatgaacttgatgtcttcccctgcatacaacatttttgcaaggtaataaacggcagcatcggggtctgaccccctcatgctttttataaatgcagagcttgtatcataatggttatctcccgtcttgtcataccgcacaacacgcttctggatacactcagaggccacatccagcgtaatatggatcaccccgtccgcccctctttcggtggtcaggattcccaattccaccgcattcagtgcatttctcgcatcaccgcccgacacatcggccaaaaactccagcgcctcctccgtgatctctgccttgaaagttcccatccccttctctttatcataaacggcgcgtttcagcaatgtctttacatccccgcggctcaaagaccgcagctcaaacacactggatcttgaaagcagagctccgtttacctcaaagtagggattctctgtcgtcgccccgatcagcgtgatggttccgtcctccacataaggaagcaggtagtcctgctgccctttattaaatcggtggatctcatcgataaagaggatggtcttcttctggtacatgccaagaagctcctttgcctcttttaccacctcttccatatccttttttccggcaattgtcgcgttgatctgcttaaactgggcgcttgttgtattggctattactttggccagcgttgtttttccggtgccgggaggtccataaaatatcagggaacccagcttgtccgccttgattgcacggtacagcagtttgtcctttccgataatatgctgctgccctaccacctcttccagagtagacggccgcattctagatgccagcggcgcttccttctcctgatttgtctctctcatataatcaaataaatccattctttttccactgcttgacaatccgaaacagaccatcaggcttttcctttctcaatgatatcccgcagggcctcccccgcaatcagaagtcctgcagctgggggcacaaaagagatgctgcccggtatgctgcggcgctgccctttgtcctccccggtatccctttcggatgtatcaatcggtttctctctggaatacagtactttcaagtgaaagataccccgggctttgagctcttttctcatcaccttgcacagcggacacacgcttgttttggacaagtctgtgatctcaaacatctccgggtgcagtttatttcctgtccccatgctgctaatgaccgggatatccagtctcagcgccagttccaccagcgccagcttggcagtaactgtatctatggcgtcgatgacataatccggcttctcctcaaacaatgcttccagattgtccggaagcacaaacatctcatatgtttttacgcagatctccggattgatatccctgatccgctccttcataacttctgttttatatcttccgatggtactgtgataggcaatggactgccggttgatattggtcaaagagacggtgtcattgtcgatcagcgtcagacggccgacaccgctgcgcgcaagtgcttcaatgcagtgtgagcccactccccctacgccgaataccatgacagatgcagccctcagccgctccatcccggtttttccaatcaataattccgtcctggaatattcatttaacatcttttcctccataaactgcagctctgctgcagcccctcaacagggcatgtatcccgactgccccggggttacgtttattctgcatgtcagtccagcatcagctcatctacggttacaaactcatacccctctgcctgaagcagatcgatgatacgcagcgccgcttttactgagctgtcgtaacagtcatgcaacagaataatatcattttcctgcgcttccgtcactactttattgacaatttcatctacattttccgtagcccagtccaatgggtcaatgctccacatcactggcagcacatggatcttcttttccagctctttctgccacaggccaaacggagggcgcataaactgcacttcctcacccgtaatgttttcgatggcctcattggtgagcattagctcctggtaggcctcgtcgttgcttaccttcgtaatttccacatggtgatatgtatggttcccgatcaggtgcccttcttcatacatacgctttacaatctcactgccgccttccttttctatgttctgcccaatcagaaagaaagttgccttcacacccctttccttcagcccatccagaagccggggcgtgtagacggcgcttggcccgtcatcaaaagtaatggcaattttcggcttttccattatagaatccgccacataggcggatgcattggcatatgcggttcccggcgcctccccttccgcctgctttccaattgtaaacagggacgggcagaccgctcccagcagcagaagcacgtatacaaaaccggctccctgcatcattctttttaaacgcaaacagcacacaacccttttttaacgattcttttatatatatgcattgtacttaaattttattgatgttataattaacacgttctacatatgaggaggttgtatttaaaatggaaaaaacaccacaagcggaaaataaaatgggcgttatgcccgttccaaaattattaatcaccatgtccctgccaatgattatttctatgctggtacaagcgctctacaatgtcgttgacagcgtgtttgtcgcacagatcaatgaggaggccctgacggcggtttcccttgcgtttcctgtgcagaatctgatgatagctatagccgcgggcaccggggtcggcatcaacgccctcctgtccaggaatcttggggagaaaaatcttgaaggggcaaatgctgccgctaaaaacggaatctttcttggcatgatcagttatattgtcatggcggtcatcggtctggccggctcccattttttctttaccgtccagacaaaagatccggtcattgttcgctacggcacccagtatatgctgattataaccgttgtctctgtggggatatttatgcagatcacttttgaacgcctgctccagtccacaggcaagacgatttacaacatgatcacccagggaaccggtgcgattatcaacattgtcctggatccgatcctgatcttcggaatgttcggcctgccgcgcatggaggtcgcaggcgcggctctggctaccgtgatcggacagctggtagcggtctgtatgtccctttattttaattgtaaaaagaatacggagctggatctgaatatgaggactttccggcccaataagacaattattgccactatatataaggttggtgttccttcgattatcatgcagtccatcggttccgtcatggtattcgggatgaataagatccttctgatcttctcgtccactgccgcagccgtattcggcgtgtatttcaagctgcagagctttatcttcatgcccatattcggcctgaataacggcatgatccccatcatagcatacaactacggggcaaagaatagggagcgaatcatggctaccatcaaaatgagcgtcctgattgccgtagggatcatgctggtggggctggtcgtgttccagattttccctgtacagcttctggaaatttttgatgcttccgaaaacatgcttggaatcggtgtgcctgcactgcgcatcatcagtctgagttttatctttgcaggatacattattatcatcatctccgttttccaggcgctcgggaacggagtttacagtctgatggtctccgtgatcagacagctttttgtcattctgcctgtggcttatctgtttgcaagagtgttcggtctttccagagtctggtgggcaattccgattgcagagattgtagccgttacggtcaccacactgatgttcaggcgcattatacggctgaacatcaagccgctcgaggagcctcggctgaacggggaactgataacaggataggactagcctcgtctgtactcggtggggctgaccagcatctgtttcttaaatgcttttgagaaatagagattattctcaaatccaacagaatatgcgattgcagcaatagacaggcttgtctccttcaagaggaggcaggcctgttttacgcggaaactgctcagatactccttgggggactgctgttggcaggcctggaatgaacggtatagatggcttctgctgatccccacataggccgccacatcttccaccgtgataggataggaatagctggttgatatataagcctttgccttttccacataggagagctgaatatccctggctggttccctgttgcccgaataatgcataaatgtggagagcagcgtgtacagggcgcctgtcatggctacagccgcttcatggctgttccccttcacctcatagattctgctcagctggccctgcagaatctttctgggcggacctccgttctctatgaatggtttttcttttgtgaaatcagttgcacggataatcggtgcagcatcggtccccataaatcctacccaggcatattcccacggatcttcacggtccgcatagtatctgacctccgtatccggatacaagataaaggtatcgccctccgccagtctgctggtgctgccatttacgctgtagaacccgcttcccgagataatatggtggatacagtaatggtcccgcactcccggcccccactgataacccggcccgcatttctgatggcccacattatagactgataaggaggtcagcaggttttcatctgctttataagaatacttataggttccttccaacatcaatctcccctttcgtctaagattttatccttttttctgatacctttattcccttctcttattatatcctcctctccatttccatgcaacattattacatatatctgcacggattttttatatacatcccatccctttttcgctataataggggcaggataaagaagaaaccagatgttactattcacggtacataggccgtgaatagtaacaaccagagaatgtatatacatagacgaaagtgaggcagaaatcatgaaagacaaattattcgcaaaattcaaagaattcttcggaagcactgagggtgcaggattttacttttcgccagggcgtgtgaacctgatcggagaacacaccgactataatggaggccatgtttttccctgtgcgctgaccctcggcacctatggcattgccaaaagacgtactgacagatccatgcacttttattccatgaacctggatagcttcggtgtggtggaagcatctctggacgacctgacaaacaaagcttcctatggctgggctaactatcccctcggcgttgtatgggccttcgcccaaaagggcatcacactggacactggttttgacatggtgatctggggcaatatcccgaacggttccggtctctcctcctctgcttccctggaagtgctcacgggcgtcattctgaccgatctcttttgtattgaccgcttcagcatgaccgatcttgcactcattgggcagtattccgagaataacttcaacggctgcaactgcggtatcatggatcagtttgccgtagccatgggcaaaaaggatcatgccattttcctggataccgcgaccctgaattacgagtacgctccggttgaactggaagatgccaaaatcattatcaccaacagtaaggtaaaacacagcctggtggattccaaatacaatgagaggcgccaggaatgtgccgatgcactcgcagcgctccagaaggagctggatatcaatacgctcggcgacctggatatggatacctttgaaaaattcaaggaggtcatccctgacccggtcaaagtaaggcgcgctaaacatgccgttgctgaaaaccagcgtaccatcgaggctgtcaaggcgctgaaagaaggaaatatcacccgttttggggagctgatgaaccagtcccacatatctctgcgggatgattatgaagtgtcctgcgaggaaatcgatattctggtcgacctggcatggaaagttcccggcgtgaccggttcccgtatcacgggcggcggtttcggcggatgtacggtcagcatcgtggaaaacagcgcagtagataaatttatcaaagctgtgggcaggggctatcaggaaaaaaccggcggcgaagcggaattctatactgtagaaatcggcggcggggcccgcaggattccgtcttaggtaacctggaaacaagatcagaaaggtggaaatgaaatgtctgtattagtattaggaggagccggatatatcggttcccacacagtgtatgaacttattgacaagggagaggatgtcgtcattgcggataatctggaaacaggccatatcgaagcggttcatcccaaagcgcgcttctatcagggagacatccggaaccgtgtttttatcgattccgtttttgaaaaggaaaccatcgacgcggtcatccatttcgccgcgaattccctggtaggtgaaagcatggtggatccgctaaaatattatgataacaatgtttgcggcactaaagtgctattggagtccatgattgcccacaatgtcaagaaaattgtcttctcttccactgctgctacctacggagagccggaaaacattccgatcctggaagatgataatacctgtcccaccaatacatacggtgagaccaagctggctatggaaaaaatgatgatgtggacagataaggctcatggcctcaaatttgttgcgctgcgctatttcaatgcctgcggtgctcataaaagcggctgtatcggtgaagcacacagcccggagacccacctgatcccgctgattctccaggttccgctgggacaacgcgattatatcagcattttcggagatgattatgacacaaaggatggcacctgtatccgggattatattcacgtaaccgatctggcacaggcccacatcctggcggtagagtatctaatgaacggcggggagagcaatacttttaatctcggcaatggcgttggctttaccgtaaaggaggtcattgaaaccgcacgcaaagccacaggtctggaaatcaaggcacagactgcgccgagacgcgccggagatccggcaaggctgattgcctccagtgaaaaggcaaagaaagtactcggctggaaaccagagcatgcggatcttgaagagatcatctcttctgcctggaaatggcacagcacccaccccacaggatttgccgatggcaggagggacgcttcatgttaagtaattctatcaaaaagctggttcagtatggaattcagaccggcctgactccggaatgcgaacgcgtttacacaacgaatctgctgctggatctgtatcatgaagacgagtatgaagatactgactgcgatctttccggcattgtcctggaggatgtgctcagaaaccttctggacgaagcatgcagccgcggaatcattgaagacagcatcgtataccgcgatttatttgatactaaactgatgaactgtctgctgccccgccccgcccagatccagaaaaagttctgggaactgtacgaaacctcacctgtggctgccacagactattattataagttcagccaggacagcgattatatccgccgctaccgcgtggcaaaggacatgaaatggacggttgatacccaatacggcacactggatatcacgatcaacctatccaaaccggaaaaagaccccaaggccatcgctgcagcaaggaacgccaaggcctcctcctatccgaagtgcctgctttgcatggagaatgagggatatgcgggacgtaccaaccatccggcccgcgaaaatcaccggattattccggtcactatcaacgacagcggctggggctttcagtactccccctatgtttattacaacgagcactgcatcgtattgaacggcgaacatgttcccatgaagatagaaaaaaacaccttccggaagttgtttgattttgtcaaattatttccacattattttcttggttccaacgccgacctgccgatcgtaggcggctccattctgagccatgaccacttccagggcggtaattacacctttgcaatggcaaaggcacctgtaatcagcacatttgaggtgaaaggcttcgaggatgtcaaagccggcattgtaaagtggcctctctctgtcatccgtctccagggaaataatgaaaaccggatcatcgatctggcggaccacatccttaaggcctggagaggctataccgatgagaaagccttcatctacgcagaaacagaaggacagcctcacaacaccatcaccccgattgccagaatgcacaacggtctgtacgagcttgacctgacactgcgtaataacatcaccacagaggagcacccgctgggtgtataccacccgcacgcaaacctgcatcacatcaaaaaagaaaatatcggtctgatagaggtcatgggcctcgccgtactccccgcccgtttaaaggatgagatggagcggctgaagacctttatactagagaaaaaagacctccgcagcgatgagattctgacgaaacacgccgactgggcggaaagcttcctgcccgggtatccggagatcaccccggaaaatatcgaccatatactccagcaggaaatcggtaaagtcttctgccaggtactcgaagatgccggagtgtataaatgcaacgaaagcggactcaaagctttccataaattcatagggattctttaggggctgggacgcggaatcgggtaagggtccgcctgtggaaagagggaggtctggggcggggaagaaaatacaggggaacctttgctaaagcagcccattctagaccgcgcattctatgcttttgcaaaggctcccctgtattttcttccccgccccagacctccctccttccacaggctgcgtgcatccgggtatgcagagaccagcctgtgtgagggaatctgcgggagagacggatgggggcggcgatacggagggccgtttttgaagggcgtatcggaaaacccggttggaatatcacgaaatttctggggaagattggaaatattgaaaatattttttggaatgcgcttccgctcccatcttcatcctcacatccaaccaagatccactgccctcgtgaaacgcctcccaaagtaagtttttatttccggccggatacgcccagcctgcctgagatggggagagggatgccgccgggacttagaggaggctttttgttcgtatagagcgcacggtctagaagtccttacgtaaaaggaactgtccatgagggatgaaaagtgattttccgaaatcacttttcagtactacctaatgcgagaaagcatcaagctttctcgctgcatgtagtacgtgccctcatgggcagttccttttgcgttaggacttctccgtaagcgggttacaaacaaaaagcctcctctaagtcccgtgtccagtttcaggacataggtaagtaaaaagtttcaggacataggtaagtccaaatgttaaactatacagaaataaccaacgaaagaaggtgtttctgtatgccatggaaggagacctctgttatggaacaacgtaaacaatttattacagaatatctatgtggaactgatagctttaaggctctctgtcaaaagttcggaatcgcagaaaaaactggacataagtggaaaaaccgctttctggaatttggcttctccggcctcgcggatcagagcaaggccccttctaattctccgaatcagctggatgaagataccgtcattcgtttaattaaaatgcgttccgctcatccggcctgggggcctaagaaactggccgttctttacaagagcgcttatccagagtcgccaacaccatctgagagtagtatttatcgcattttgggaaaagctgggttgattcccaaacgacgctttcggcatcccgatccaactgcttccaaactgcgtaataagttggaagctcttcaacccaatgatgtctggaccgttgattttaaaggctggtggatgtcccagggggaacgctgtgttccactgaccgtccgtgatctgcacagccgatacattcttaccatccgcctgatggagagaacaactgcggatgctgtcaaagctgtatttgaagaattattctatcactacggacttcccaaaatcattcgcagtgataatggtactccttttgcttcctcaaatggcttccttggtttgacaaccttaagcgcatggtggatgtctcttggcattcttccggatcgtaccgatccaggctgtccaacgcaaaatggtgcccacgaacgcatgcatgcagatataagcagggagattcaaggaaaaatacctggtggcagagaggccaatcaagccgccattgatttgtgggtggaagaatacaacaacatccgcccacatgaagccttacaaatgagtaccccctccgatttttataaaaaatctaccctgctatacgaagaagcgttagcagaactggaatatccgattggttacctgccaagaaagattaacaaacatggagaagtaaaaatcaacaaaacactgtattctgtaagtttatcacttcgaggcttacaggtaggagtgcagccaaacggtgataaaacatatatcatttggcttcacgactttccacttggaatgcttgatacaaaaaccgcttgtataacggcaatggatgttttaaactgatactaattaacaattcgacttaccacctgttgaatcgacttacctatctcctgaaacaaaagacttacctatctcctgactggtcaccggcggcatccctctccccatctcaggcaggcgccccccacccgcaaacctacttcccccgtttcctcttcttgcgaatactatatccgaaggttccgattttttttcccagccccaggtattctccatgggaataggcgaggagtcctgttttattgagttcgaacttgtttttttcgtttaggtaggattcgtcaacctgtactgtatttacctcggccaggaacatgtgatggctgccgagttctttgatctcggtcacccggcattcaatgctgacaggacattcttttatgaccggtgcatagagcagagtctcggcgggccccggtgtgaggcctgtctctttccatttgtctgtgtcacggccggatctaaccccgcagtagtccgtagccttcgccagtttttctgttgtcagatttataacgaattcacccgtgtcttttatcatctgataggaatagcgctccggccgcacggatatatagaccatgggcggattcgtacagatggttcccgtccatgcgacagtcaggatgttttgattgccttccttgtcccctacgcttaccataactgccgggagggggtacagcatattgcctggtttccatatttgtctgctcatgaatgtatgtgcctcttttctttctcttccaagtgatgggtactttaatcagtttcaatcacgatatgatcctattgctgcagtgcgcctaccagtgttggcacaagctgtttctttctcgatacaacccccttcagaaggagatcctccgtatcctcacgcaaatcgtaggctgacattaccttttcccttgcatccggcccgcagcagagcagttcggaggattcggtcacgatattggtcagcatgaaaaataccatatccaggccgtgtgattttcgcgcgctatccagatgtggaagcactgtggtcttgatttccttcagttcatccgcactcatagagttcacctggcctacgcctataacggtctcattaactgtaaactgtttgaagtccaggaagataatttcttccgcactcttgccttttagattgctgcccgcattgaacatttccagggccaattcttctatattgatgttcgcggccctggccagactccttgcggatgcctcatccagggatgtacatgtgggtgagcggaacatcagtgtatcggagatgattgcggaacagaggagagccgctatcgtcggctccacttccacgccttcttcctgatacatctggtaaataatcgtggctgtacagcccaccggctgatttctgaaaaataccgggcccatcgtctcaatgctgctcagtctgtggtggtctatgatttccagtacatcagcctcttcgatcccgtccacagcctgattcttttcattgtgatccacgaggatcacctgcttcttcctgcagttaagaagcctccttctagaaataaatccaaggaaattccctctattgtccagaatcggaaaatcacgaaaccgcttatgtgccatgacctccttcacatcatccacataatcacgcatcctaaatgatatcagcccctccttagtcataaaatgcctgacaggaatgctctggttgatctgtctggctacggtaaacgtatcatgaggcgtacttatgatcacaatctccttctcccttgcctgatcaataatgtcatccggtacttctgccccctggcatacaaccatgcatcccacattcaggtcaatcgcgcactgctgggcttctcttcggtttcccaatattaccagatcatcctgttctataaaatccgacattagatcccggctggaagctgcaatgcctacttttcctttcagcagatagctgtggtcattaccgatcacgacccgcccgccaatcgttgtcgctatattgcggtactgcgtcctagctctcgacagaattgtactatcataaacatccatataggatgtggcgatatcgccgatcgtaatcagcccttccagcttcccatccctcgtaaccggcagtgtcttaatattcagttccttcatccgcgcccaggccgtcttaatcgatacactgccgctcagcccttcaatcttcctcagttccacgtccttaacctgtatacgcagatccgacaaaagtgcaggaaccttcaccttaaaacgatccagcacatattgggtctcctcattcagctgccccgccctgcgaggagtatggtcctcccctgtcacaatcgtcttaagccttgcataagcaatcgcagaacaaatagaatccgtatcaggatttttatggccgactacatatacttttcgtttattaactccattatccattttatatcccctttaagcataaattcacataatagtagattgccacctttttaagttttcgtcaaccagattttaaacattcacattatttttacataagatactactcaaaaaacggcctgaatcccacatctgtccctatcccctgtatttgtcctccccccatatactatcaacttttccccaatctcatccgcctgccctcgttttacctcctcttcaagaaaagagttcttccctgccggcaggatgaaccagcctggcgggtgactggagggggatgctctgacagtggatgggtgcaggcctcctgaagggcatacatgtcattcctgagcgctaaaacgggccttagaaattcttggaggcagacagccgggaaaatggggagattccgtgattccgaatcacggaatcagctgacccagcgtgggaaaatatcgattttcccatgatgtgtcagctgtgccccattttcccggctgcctgcctcctagaatttcttagatccgtgtccgcgcttcagaatgacatgtatgcccttcaggaggcctgcacccatccactgccagagcatccccctccagtcacccgccaggcgtcctccctcaaaaaactctcaatctaaattcagtaatgttacaagacctgttgttttttgtggcacaaatatgctatacttatactatatggactacatgaattataaaagataagttgaggtgcgacgatgagtgaagaattgagaactgaagaattacagacaaacgatgaaccggttgagacaatggcagattacgaggaacattttgatgatgccaacccatggaacagagtgatggattatatggaaaagaaaacggttctgccagttaaggtagaaggcattgtcaacggcggtgctatagccatggtagaagggctacgaggatttatccctgcttccaagctttctctttcatatattgaagatcttgaaacatatttactgaaggacatagaagtccgcgtgattgatgtggatcaggcgaataaccgccttgtattgtccgcacgtgagatcctgaaggaaaaagaacagcaggcacgtgcagaacagattgccagcattaagaccggcactgttatggaaggaactgtagagacgctgcagaactatggggcattcattaagcttgacaacggtctgtccggtcttgtacacatttcccagatttcccagaagcgtattaaaacccctggcgaagtactgaaggtgggcgacactgtgaaagtgaaagtaatcggcatcaaagaaggaaagatcagcctgagcatgaaggctctggaagaacatcaggaagaagttgaagaaagagtcgagattccgaagagtgagaacattggaaccagtcttggagatctcttcaaaaatatcaaactttaataactgattgttaaaaggcatcatccctatgaagtattcacagcggatgatgccttttcttttccgacacgctctaaagttcgatatctttgagatacggattctccgtctcgtagaatttttcctgttctacggcttctgcaatctttgtatcgaccggcatcttgccaagaacaggcagtcccagatctgctgcgatctcatcgatgtggctttcgccgaagatgctgatctccttgccgcagtccggacattttaaataactatagttctctacaattcccagtaccggaatattcatttgtttcgccatattataggcttttttcacgatcatctgtaccagatcctgcggagaggtcacgataactacgccgtctaccggcagggactggaatacggtcagaggaacatcaccggttcccggcggcatatccacaaatagataatccaggtcgccccacataacatcggtccagaactgtgtgacaacacctgctatgaccggccctctccagatcactggggtgtcctcttcctccagaagaagattcacggacataatccttgtctcatcctttgcaatgcaggggaacattccatcctcactgccctttgccatctcgtgcacgccatacatcttgggtatggacggccctgtaatgtcggcgtccagaatacctaccgtatatcctttttcacgcatcattctggcaagtgaagcggtcacaagagacttgcccacaccgccctttccgctgataacgccgattactttttttacctgtgaatatgcatttgcagggactctgaaatcttcttttttactttcgcatgtcccggcatgtgaacatccggagcaggattgctcactgcagccattgttgtactcttctgccataatactctaccttctctttctttcatgataccaaatccgggccttcgtcctgaacgccggcccactgttcctattataacacactctaaaaaaaagtacacccatgggagaaaactaatcgttactgtacacgcccgcagtaacagttcaggcctgcctgaactgttaccgcccgcagggtatgcacagtaacaactaatccaactcccgggtcacgtccttcagccatttatagctgcggtacctgatccatgtgataggtactttaatcagttcgtcgctcatcagtatgatatagactacgggcacgccgcagtggaatacaaaggctgccaggaaaccaaagagtatggagcatccccacatcgtagcaacgtccatgatcaagccgaacctcgtgtctccgccggagcggaacgtcccgaccaccatcgttgtattgaacgactgggcaatcacgaaataagacataacaaagaacataaacttcagatagctctttgccgccggtgtcagtgaaagaagagccgctgttaccggagctgccacgagtataatcacgccgcctatcgcccccatcaccacgcttagaagaaggaagcggtgtgcataggcctttgcatgttcgaacttcttctcccctatcgtcttgcccagatagatcgctgtcgcgctggacagtccgaatgcaactaccgtcgccagctgcctggccacctgcgccacggaattggccgccacagccgcactgcccatatgtccaagaatcgcggtgtttgccgccgttccaagcccccacatcacctcattcatcactaccggcagggcataccggagaaagtccctcaccagcagtttgtctgtccgcataagatagcggaaacggaacttaatgtccttattaaagagcctggcataaccgaacacaagtattagctccacaaaccgggctgccagcgtacccagcgcggctccctgtattcccattgcagggcagccgatgaggccgaagataaagatcgcattcagtatgacattgcagatcagagagaccaggtatacaaccgttgcgactaccacccgttccacgctgcgcataataaaaaggtaaacctgggtaattcccatcaagacataggaaaaggcaacaattctcagatacttcataccctcggaaatgaccgcaggatcatttgtaaatatccgcatcagaagatccgggatcagcagggccgccaccgtaaatatggcagtgacaataatggccgctttcatccccagtcccagaatcttttctatagttttcttatctcccttcccccagtactgtgcagtcagcactgtggcgccggaggtcagcccaaacaaaaaaagcaccatgatatactgcacttgtcccgccagggacgctcctgaaagcgccttctctcccaccctccccagcataattacatcggcggcggttacccccacattaatcaggttctgcagcgccataggaattacaagagcaaaaacactccggtaaaactttccccagtcaatccctaatccgtcatctccaaatagtattcgcttcataaatgtcatatagtcccgtacctctcctcactcagttttctttcaatcccagaaaaaatgttctccgcactgtgcagagaacatcttttttagattctaacatatattcccagaaaggtacagtcctgtttttacagtttatgcccctatcttcttcttttttgacactgccatagcgatacacaggatagccgctgcaaataccagctggatgccaaccgcctgcagcacttccgtgcgcacactgcctgtaatatttccaaagtccgccagcatatcattcgctttttcgtaccagtaaaccggcaggaactgtgcaactgttattacccctttattcagaacatccagcggcacaaagaccccgcacaggaagcacataccaagcgacaccgtattaacaataccgttgagtgcatttgtattgttggtcagcattcccaccagatatgccagcgccagaaccacgagcagaaccgccagcgagttgagcagatagtaaggaatggaactgctcttgaggaacgctttgccatagagaaccaggttccccagcatgcagaccgcccacaacgctccacccatgagcccggcagccagaagcgcttccaggttctgcctccggtttgaaactgcgcatgcctgcattcttttggggatatcccctttatggaatgcggataagatatttcccagcacatagcagaggacactcatcatcagatatggaatgtatctgaaataataagtataacctggcacttctcctgcattgccattgatgtccagcatggtgatctctgccccctgcctttccagagccgcatcaactgcatccgatgcagaatatccggctgcatagtaggtcttcacactattcaaaaaactggtaatctgctgatccacataaaaactggtgtaagagccgggcaccttcgtcacctccagcttctccccgccttccagacactttttttcaaagccggcgggaatctttactatatactctaactctctgtagaacaggctttcctgtaatttttctttgtcattatctatcatagtcaggttatggaactgtccaagatactccttcagcccttttgccagagcgcccccgtcctcatcaacgatgcctacatgtacgctttccgcgctgtagctgccgctcccggtatcttttgtaactgcctggatcatcatagtgatgccgaaaaagatagccagatacatcagcatcagtcccacatttgcttttacaattttcatataacctttaaatactgtcataacgttccctcctgactgctaagaatgatcccaggatcagcaccactgacatgaacgttaagatgagaaggctgcgcctgaatctcaccggatcatcatagacattgatacagtagaatgcgtctgatatcagagccgccgggttaatgcggtttataatcgggcagtatctttctaccgtatatttcatttccgagttcatcagccctgccagaaaactgcataccatggagattccgaggagtatccctatcttgatgccttccccaaacttgctgatactgctgataaagattcccatggaaacaccgatcagacagcctatgaatgatacgagcagcatctgcggcatttcccctctgaattccaagtgaagcacataacgcagatataatagcaggatgatgatattcataaaatgtataccaaatgaagtcagcatctctgacaggatcagtttcagtttatgagtcggcgtaacgcatcttctggacgcaagtgcggtcaggttggcctgcagggtgagcgcggaaccaaatccaataaaacagccgtacagacagcccattgcgatgagcgcataaaagaactgtgagtttccgtctgttgtcttgccgcccaaagaaacctgttttaccatctcctgataatcggacatctgggcggctgcattacggattccctccgggtgtcccgccgcgatcgtcatcatcgtctgcttcccgtccaaataactttccagcagagactgcaggatactttctcccattcccacgcctccaacggtaagggttggagtctcccctacatagaatatcccggatatctcttttcctttcagagcacggagtgcctttttttcatccatagtttctatatggatcagtttggaatcatcctgctccatcatatccagaaactccaaaaattcctggtccgctgcctgccctttttcctctacaaccgcagccggcactgtctcaaaatcagcttcgtctattttgccgaacgcaaagtaaaagaaggtagccagcaaaagcggaaaaaagaagggccaaaacagcatattaaaattatgcagctttactttgacatcatatttcattaaatgcagcatgtgatcccctcctagtctctcagctcttttcccgtgatttcgaggaaaacgtcattcagtgtcggaagctccgagaataccctgccgaatggtatttcattttcctgtaaatagttcaatatacgtatcagattgtgttttgcccctgtgcagcgcacggttagtgtctgttcttcatattttacatcgaacacatggggcagaaggcggatatccttgatctgttccgaatcaagagcagctgcctctatggtaaccgtctcccctgtcttaatcatgccctttagttcttcttttgttccgaccgcaatgcttctgccgtgatccataatagcgattttagtacagatctgttctacctcctccatgtaatgggatgtgtagatgatggtagatccctgtctgttcaattcctgtatcccctccagaatccggtttctgctctgcgggtccaccgcaacagtcggctcatccatgatgataaggcggggtttatgtgcaatgccgcatgcaatgttcagacgtctgagcaggcctcccgaaagcttctttggccgcatttttatatagtcctccagccccacaaagtgaatggcctccaaaaccagcttttttcttctctctctttctttcacatacagcccgcagaaatagtcgatattttcatagacagtaagctcatcaaagactgctacattctgaaggacaattccaatctgctgtttaataccataattatcaggcctcatctcctcgccgaaaatgcttaccgtgcctttgtcgtattttaaaagtgcgagcatacagctgatcgccgtcgtttttccggatccgtttggaccgagcagtccatatatctccccttcctctatctccagattcaaatgatccagtgccacaagttttccataacgttttaccaggttttctatttttatcattccaaagcctcctctgacttcattttccttagccgctcggcggccttgttctttatagtctcagtatactttcttttctttccttccggtagtgtcatacgtcatgatcttcatgtgacaaatgtcaccttctcctgtatacgtccgcagggtatatacaggaacggtatctcttacctgcggagcctgtaccatattagttacgtatccagccattttatgatataatgagcgttagttagaaaagcgtgtctgtatattttccgaacggcaaatggcggtcatgagtctttgattcatggtataatggaaaatataacagactgtgatgatttatccgcacagaaagaggttcccatgaattttttcagagacactggattattgattatattttgctttttcactttatttcatgattcaccggatattgtttatgtatttgggtttttaacggctctgattatctgctgcgccgattattttctggagctgaataagctgctcctgcccatctccctcctgtatctgctcgtatccatactgcttcctgagctgctttatttttatccggcatgtgcatatgtgctcctgcatcataagcgctatattcctgtcgctgcaggcctttgcctgtatatctgggcatatggcatccgggaagcagacctgtaccttctctttcttggaatcttcggggtgatgctagcctttctgctccaaagaaactcgggaacctatgagcagctggacagtctctataaacggacaagagatgacagtacggagctgaatcttcttcttacggaaaagaaccatgcactgctggaaaaacaggattacgagatctacgccgccaccctgagggaacgcaaccggattgcccgtgagattcatgataatgtcggacatcttctttcccgctccattctcatggtgggggccctgcgcgccgttcataaggagcctgcactgtcggagccgctggagaccctggattctactctgaattctgccatgaacaccattcgcagcagcgtgcatgacctccatgatgaggccataaacttagaagaggcggtgaacagcctcctcaaagattttacagcctgcacggtatcatttgaatatgacatgagccgggaattaccccgggaagtcaaatactcctttatcagtattacaaaagaggcgctctccaatatcataaaacacagcaatgcgacacatgtaacgattattatgcgtgagcatccggcactttaccagctcttaattgaggacaacggaacagccctttccccctcgggtaccgggatcgggcttgtcaatatgaaagacaggatccaatccctgaaaggcaatatacagattcagacagacaaaggttttaaaatatttattaccataccaaaggagatttaaagtatgaacattttgatcatagacgatgattttctcgtagcaggagccctaaaaacgatacttgagacgcaggaagactttcatgtaccggcctgcggaagtgacggaagtgaggcagcggcgctgtttaggcagcaccgtcctgatgtccttctcatggatatccgtatgaaagatatgaacggactggatgcttcagcggaaatactccgagaatttccggaagcaagaatcttgcttcttaccacattttctgacgatgaatatattatcaaagcgctgaagctgggtgcaaaggggtacctcctgaaacaggactaccaaaatatcgtgcctgccatccgggccgtgtattcgggccagaccgtgttcggagatgccatagtctcgaagattccctcacttctccagaggcccccggccttcgactacgcttcctatgatatcaatgacagagaattggaaatcatccggctcatagccgacgggctgagcaataaggagattgcctctgctctgtatctgagcgaaggaactgtacggaattacctgagttctatcctcgataagctggagctgagggaccggacccaggttgctgtcttttattatcagcacaaataatgccggcacacaaaattacagccaaaatattctcagcaaaaaaaagaaaggttctgatatttatgccattacagactaccgatatgtctcttgtccccagcgggcagctggaaccgcttgacatgatcagcggttttctcgtccgtccgggattttttaatacctttggagcaactatcattcccggaggggtcaattttacaattcagtcccataaagcttattcctgcgaactgcttctcttccacaggaaagcagagaaccctttcgcagtgattccctttcctgaacattataagatcgggtttgtctattctatgattgttttcgggctggacatcgaagatttcgaatatgcatacagcctggacgggccttatgacgagaagaaaggccttcgttttgataaaacaaagattctgctggacccttatgccagggccgtcaccggccagagcaaatggggctgcatgaactgctcacagcacggctaccgggcgcgcgttgtgcgcaataatttcgactggggacgggaacgccagcctcagatccccatggaagatatgatcatctatgagacccacgtcagaggctttaccaaagatgattcctcccgtgtaaaacatcccggcaccttccgggggctggaagaaaagatcccatacctgaagcagctcggcatcaataccgtggagctgatgcctatctttgagtttgatgagatgcgcgatgcacggctgctggacaataaccagctgctggactactggggctacaatccggtcagtttcttcgccccaaacaccagttacgcctcttccgtggaatataaccaggagggcagggaactcaaggaactgatcaaaaccctgcacgacaacggcattgatgtgattctggatgttgtgttcaatcacactgccgagggcaatgaatacggcccctgcttttgttttaaaggatttgataatcatatttactacatgctgacccccgatggttattactataacttcagcggctgcggcaatacgttgaactgcaaccacccggtcgtacagcagctgatcctggactgcctgcgttactgggtgacagattaccgtgttgacggattccgcttcgacctggcgtccatcctcggccgcagcgacgacggctctcctatcagccagcctccgctgctgcgcagccttgcctttgaccctattctcggcaatgtaaagctgatcgcagaagcctgggatgcgggcgggttataccaggtaggctccttcccatcctggaagcgctgggcggaatggaacggcaaataccgggatgacctccgcagattcttaaaaggagatgcctgcatggccagagccgccgccatgagaatcctgggttcacctgatctatacgatccggattccagaggcctgaatgcctctgtcaacttcctgacctgccatgacggcttcaccctctacgacctgtactcctacaaccagaagcacaacgaagccaacggctgggacaataccgacggaacggatgacaacaacagctggaactgcggtgtagaaggcgaaaccgacaatcctgaggtcaatacactccgtttccgcatgatctgcaacgcctgtgcggtcttaatgtgcagcagaggaacccccatgttcctcgctggagacgagttcggggatacccgttttggaaacaacaatccctactgccaggacaatctcatctcctggctggactggcgtctcttagagaaaaacaaagatctcttccagtttttctgctacatgaccgcctttcggaaaagccatcccgtaatccgaaagaacctggctcccagccgtacaggttttccgtgcaccagtgaacacggcctgaccccctggacaccagactacactcccgaatccagaaccataggaatcatgttcgccggatacgacgaagaaacgaaaaaagaagacatcgtatacctggcagtgaacccctactggcgaacactagaactaacccttcctgagctccccccggattacagctggcacatagcagtaaacaccggcgattcgtcacaaatgctttactatgaaaacactgcccccaaggcaactggaaccgtactcctgggaggccgctcaatcatctgcctgactgctgcttcccaatatcagtaagtccccctttctttgacggcagctagcccccgagagcacgagtgacatataaatcctttgatatttaattaagtccttatttaaagtagagttcagtataaccaccattgaaactatacccgccttcgatccccatccccgcagcgttcctcccgccttggacaccccagcttagtgatacctcggaacggccgtcctcccgggaatcggatataggggcagtcggaagcgtcttttggctgttagttggagttaaggaaaagagaagaaaaaccagggtgattcttgtgagcacaaatcacaaaaatccctggccccggcgcgtgaagccatcaaggcttcacgtgatgtggccaggttaccctggtttttcttctcttttgctttactccagcttacagtcaaaacccgtttctccgactgcccctatacccgattcccgggaggacggctgttccgaggtttcgttaagcgtccttctcttcactcatccagcgcatccttcaccttccctctgaacccttttttcttcccctttgtaggtttgctttcctcttccggttccacatcctggttcagtgaattccccgataatttatcaaactgcttcaatgcttcctttgcctccgggctaagtttttccggcgtctggatgactaatgtcacataatggtctccccgcacctgagaattacgaagggacggaacaccttttccttttaagcgcacttttgtatctgtcttggtgcctgcttttacggtatacaaaacgtccccgtctacggtaggtactctgatgtccccccccagcgctgcctgtgcaaatgtaatcggtacggttgagaagatatgcatatcctgcctctggaagatcggatgtctgcttacatttacttctaccagcaaatcgcctctcggtccgccgttaacccccggctcgcccttttcccgcaaacggacgctctgcccgctgtctatgccggcaggcacaattaccttgatgcgcttcttgctggatgtatatcccgtgcctgaacaggacggacatttttctttaatgacttttcctgaaccaccgcagttcggacaggtctggacattctgtactgtgccgaagaaggactgggatgtatagaccacctggccttttcctccgcacttcggacaagtctcaggagatgtgcccggctttgcccctgttccgttacatgctgtacatggatcctttaatgcaacgtccaattccttctcacacccaaagactgcttcctcgaatgtaattctaatactcttgcggatatttgcccccttcatcggaccgttgctggccctgccgcctctgcgtccgcctccgccaaacaaatctccgaaaatatcaccaaatatatcactgaaatcagcaccgttaaaatcaaatccgccgaagccgcctgctccgccggccccaccttcaaatgctgcgtgtccaaactggtcatactggcggcgtttatcagggtcgctaagtactgcatacgcttccgatgcctctttaaaccttttttcggcctcggcatctccgggattcatatccggatggtactttttggccagaactcggtatgcctttttaattgccgcgtcatctgcatccctgcctacgccaagcacctcgtaataatctctttttgactctgccataacactctaccctttcatctgtctgcttaattctgccacaaaaagacgctcgcagcctttttatagacagtttgcaacaaagaaattctacgaggccgcatttcgcggcttcgtagaacctttctgccaacggattttatacttctttataatctccgtctactacatcatctccctggtagccttccggcgccggacctgcttccggtcccggaccctctgagaagcctgctccagctcctgcaccagctcctgcctgctcgtacatctttgtaaataacttctgagcgctttccatcagtttatccttggccgccttgatctcagcaacctgagcgtctgaggtatcttccggagtagattttgcaaggatatctttcaatgcctggcagtcagcctctacggctgctttgtctgtagcatccagtttatcgcccacttccttaatcgctttttcggtctggaataccatactgtcggcttcatttctcgtatcaatcgcctctttacgtttcttatcctggctctcgaattcagcagcttccttaactgccttctggatgtcatcatctgacatgttggagcccgccgtaattgtgatgtgctgctctttgcctgttccgaggtctttcgctgatacatttacgataccgtttgcatcgatatcgaatgttacttcgatctgcgggattccacgtggagccggcggaattccatccagcctgaactgtccgagagacttgttgtctcttgcgaactgtctctctccctgtacaacattgatatcaactgctgtctgattatctgcagctgtggagaagatctggctcttctttgtaggaattgttgtatttctttcgatcagtcttgttgctacgcctcccattgtctcgatagaaagtgacagtggtgtaacatccagcaggaggatatcgcctgcgcctgcgtctccggccagcttgccgccctgtacagaagcgccgagtgcaacacactcgtccggattcagagacttacttggctctttgcctgtcagacgtttcacttcttcctgaactgcaggaatacgagtggaaccaccaaccagcagtacctggcccagctcagatgcggagatgcctgcatctgacagcgcgcgtcttaccggttccgctgtcttttcaacaagatcatgtgtcagttcatcgaacttcgctcttgtcaggttcatatcgaaatgcttcggtccttcagatgtagctgtgatgaacggaaggttgatattggttgttgttgcggatgaaagctcttttttcgccttctcagcggcttctttcagtctctgaagagccatcttatccccggataagtctacgccctcttttgatttgaagtcagccagcatataatctgtaatcttctggtcaaaatcgtctccgccgagtctgttatttcctgctgtagataatacttcgataactccgtctccaatttcaatgattgatacgtcgaatgtaccgccgccaagatcgtataccatgatcttctgctctttttcattgtccaggccgtatgcaagcgctgctgctgtaggctcgttaatgatgcgcttcacgtccagccctgcgatctttcctgcatcctttgttgcctggcgctgtgcatcgttaaagtaagccggtacggtgataactgcttccgttactttttctccaagatatccttctgcatccgctttcattttctgaagaatcatagcagaaatctcctgtggagaatactttttgtcatcgattgttactttgtaatcggttcccatctctcttttaatggaagagattgttttgtctgcatttgttactgcctgacgttttgcaggttctcccacaagacgctctcctgtctttgtaaatgctactacggacggagttgttcttgcaccctctgtatttgcgatgacagtcggctgtccaccttccataacagctacgcagctgtttgttgtacctaagtcaataccaattattttgcccataatcatttcctcctaaaatattttgattttgaatgagaaattagtttgctacttttaccatactatgtctcactacactgtcgcggtatgtgtatcctttttggaactcctcggctacgatattctcgccaagttcttcgtcctccacatgcatgactgcattatggaagtccgggttaaattcgtttccaaccgcctcgatcggtttcacgccaacctcttctagtgtagtcatcagctgtttataaatcttttccattccctctgcaaaaggattggactgttcttcctccggcacagctgccaggccgcgttcaaaattatccacgaccggaagaatcttttctatgatatctttcgcacctatctcgtacatctgggatttctccttttctgtacgcttgcggaagttatcaaactctgccatttgacgggtaagcctgtcagtcagttcttcgatcttctcgtcttttttatcttttttattctttctgccgaagcgcttcttttctttaacggatttgtcttcttcatcctcagccgcatccggttcttcattatcttcggcttcttccgcgtcctcaccgctttctgtgcattctgtttcttcctgtacgtcctcgcaagcttccggcccggcttcggactcagactggttttcgtctctttctttttccgcttcctttgcggccttggccttggcttcctctacggcttctcttaccatatcttctttgctcatcttctcttccaccagctattcaccttcctattcttttgggtctttgtaataaattgcatccaactcattctgcagagtcttcagcgtcttcatgacatgttcataatccatacgctttggacctataatacctatagtacccttcatgccctcgcccaattcgtaggttgctgtcacaacactgcagtctttcatggtcttcaccggtgcttcatctccaatgtatacctgaattccatgattatcttcactggccagtgtctcggtaacgagatcggccaattgctgcttttcttcaaatgcactgataatttcctgtgcgctctgcttatcgctaagctccggatacttaaaaatattcgtggcaccgctggtataaatctccatatcatcatccacatggatgatttctgccacagcatccagaacatcactgatcacctggctgtgaatcccagcctgttccttcagccttgcgatcaggccgaggttaatctcttctatggacatcccgttcagggtcgtattcagcagcatattcagctttagcagagtctcactacttaaagtttcaccgacatcaataattttattcttgatgacgttgcctcccatcacgatcactgccacaatctgttcttcatccacctgtgaaagctggataaacttcaatgtgttcctgctgttgaccggagccgaaaccatagtcgcataatttgtattcgctgcaagaactttggctgcctgctgcaatatcttgtcaactttgtctgtcttctccagcattgtattcctcagttccgtgatctcctgctctttctcctccatcagcatatccacatacaaccgatagcctttgtctgaaggaatgcgccctgcagacgtgtgaggctggaatatgtatcccagatcctccagatctgccatctcgtttcgaatggtggctgaactcagattcaattccgtatatttcgaaagggttctggaacctaccggttcgcctgtttccagataattccggataattgcttttaatatcactaacttcctgtcagtcatttcagtaactgctgccatatccggaccctcctttctgattcagccttctcgcttattagcactctttacttttgagtgctaacaccttacgtatactaagatagcaccatgaataatttttgtcaacagtctttatatattttttatacaaaatcgggatatagttaacgagctttagacctcgtcattcgctgttgcatccaaacggtagttaagagctcattccccagaggggccctcgtacggtagcaacggatggaacagaattggtgattcgtttatataagtgtaagtgttagatcgccttgttacccgtaaatatactggatttaaaagattgtatggttcattaataaaaaaacatatggagttacacacgataatcgttactaaataaatagatttcttcaaaaacagtcccaaagctcccatacataaaagccttaaaatccatttaatcaagatgcatgttacgcatagccaattccatccgcctccccggcctccctgtcataaagctggctcatccaatcggctggaaagctcgccaaccgggtgggatcccggaccagggcagcggatgtggattggctatgcgtatcttttcatctttaagatgtgtattgaattattttgatactggaaccgtatcccatcgcttatgtacacctactggggacataaaagtcccgccaattcaataccatacgctgcccccgcttgaggcatctccttagaaacgagctttttcctgccggccggatgcgccagctccatgaagggatagccgaaaacctcccggagaacatccatgtcctttcaaaaacgctcaaagcggaccttagaaattcttggtgggaaacagcccggaaaatggagagatttttggattccgaatccaaaaatcagctgacccagcgcgagaaatcatcggatttctcgtgatgtgtcagtggtgctccattttcagggctgtttcccgcctagaatttcttaggtccgcggccgcgtttttgaaaggacatggatgttctccgggaggttttcggctatccctttatggagcgcccccatccgcgccgagactaaagctcgtcactaaatcccgattttacaaaggtttgattgaatctttttatgagaagtcgtagaatatataaaatgatatgtttttactaattaggaaggaaaacactttcggatataaagtgccggaggggtgtttttgtaataggaggattcttatgaagaaattatgggaattgtatgcgactttttttcgtgtaggagggcttacttttggaggcggcatggctatgctgcctatgttgaaacgtgaggttgtgctgaaaaagaaatgggctacagatgaggagattctggatatctatgctattgggcagtgtactccgggtattattgcggttaatacctccacttatatcggatatcaacaggctggcgttccgggagctgtttttggtactttgggaatggtaagcccttctgttattattatctgtctgatagccagtattttgagccgttttatggacattccggtcgttctgcatgcactggccggcattcggattgcagtttgcgccctgatgatcaataccgttatctcgctggccagatcaggcatccgtgataagcttggcctgctaattttcctcgctggttttctactcgccacattctctccggttcctactattatactggtcatttgtgccgccgggaccggcatcattgtaaatatactgaaggagaaaaaacgatcatgatctatctcaccttatttatagaattctttaaaatcgggcttttttctatcggcggaggaatggcaaccgtgccttttttaatggagctgacccaaaaatatacatggtttacgaaaacggaactggcaaatatgatagcaattagtgaaagtacccccggcccgatcggaattaacatggcaacctatgcaggctttcatgcagggggaattcccggagcgctgactgcaaccatcggcctaatctgtcctgccctcattgtcataatcatcatagccaaattcatgtccaacttcagcgaaaacaaatacgtcaaatccgccttttacggaatccgtcccatgatagccgcactgatcggatacgccgtatggcagattgtccgtataacattcgccgacgccagcaaagaaatcctctcactcaactataccgccatcctgatcggatttgtcatcttcacactgctgcagatcaaaccactcaaaaacatccatcccctcatatggataatagcaggagcggtggcaggagttattgtattgaaatagtggtatgctgcaaacttcccccaatcattaaagcagctttaccaacatcgcctttcaataccgaacctctccccaactcaatccgccgcctccccagaaatccccctggtaatttttctcccgccctgatgcgcccagccatcgaggagctagatgcaccagcggcatgcgggaaggcttatgccgctggtgcatctagctcctcgatggcgcccccacagccacaaaaaaattaccccataaattccaaaaacaccaaattactgacatcgatccctctttctgtcagccggatacgatctcccgacatttccaacagcccgctatccatcaattttttcatttgtgtcccataaacatcaaatatactctgtctatagagttcttcaaacccggaaattgaaattcctttagtctttcttaacccaagaaacatgaattcttctatctcgtctttaaccgacagttgttccacgtcctcttttatgtccgctttctcctgtactttttgtatataggatcgaatattacccgtattgtgatatctgctcctgccaataagggaggaggcacccagaccgattcccaggtattcttttctctcccagtagcccagattatggcggcaggcatatccttcttttgcatagttggagatttcgtacctctgatagccatactctgacagaatctctgctgtcatctcgtagatttttctttctgcgtcttcatctggcagcggcggcgctgtattttctgctgcatggctttccgtcagaccttgtccggcatttcccccatatctttcataaaaaggcgttcccgcctctatcatcaggctataggcggagatatgctccggatccagccttgcgactttggtgagcgtctttttccagctcgcctctgtctgtccggggatggctgagatcaggtcgatattaatgttatcaaaaccctgttttctggccagatcgtaggttgtgagaaactcttcccacgtatggattcttccaagcatcttcagctcttcgttatccgcggactgaagtccgatgctcagacggttaataccggccgctttccaggctttcagcttctcttttgttacggttcctggattggcctcgattgtgacttccgcattctctgcaatctggaaactttgatgcagggcgtcaaatattactataacctgatctcccgtcagcagggagggagtcccgcctcccataaatatcgtcgtgacctggtacggctcatggtatgcttcatatccctgtatttcgcaaagcagcgcattcacatactcctgctttgcgtcctcatccgcaggcgcagagagaaagtcgcagtatgcacattttttcacgcagaaagggatatgcaggtacagctccagttctttcttcatattacttatcatccaatttcagcacgctcatgaatgccttctgcggtatctcgacgctgccaacctgacgcatgcgcttctttccttccttctgcttttccagaagctttttcttacgggaaatatcgccgccgtagcattttgcgagcacatccttacgcattgccctgacggtctcacgggcgatgatcttgctgccaacggctgcctggatcggaatctcaaacagttggcgcggtatctcttctttcagcttctcgcacatctttctgcctctctcgtatgcggtgcttccatgtacgatgaaggaaagggcgtctacctcttctttattaatcaggatatccagtttcacaagttccgactgcacgtatcccagcatctcgtaatcaaaggatgcatatcccctggatcgtgacttcaaggcatcgaaaaagtcatagatgatctcattgagcggcagatgatagtgcagtaccgcacgcttctcttcgatatattccattccctggtattctccgcggcgctcctggcataagtccatgattgcgccgataaattcggaagtcaccatgatctccgcttttacgattggctcctccatgtattcgatctccgcaggatccggaaggtttgtcggattcgtcagatcaatgatatctccgttggttttgtgtaccttgtaaataacgctgggggccgtggtcaccagatccaggttgtattcccgctccagacgctcctgaataatctccagatgcagtaatcccaggaagccacagcggaaaccaaatcccagcgcaacagaggtctccgcctcgaactgcagggccgcatcattgagttgaagcttttccagcgcatcccgcagatccgggtacttcgctccgtccgccggatacattccgcagtagaccattggatttacttttttatatcccggcagcggctcctcgcagggtctctccgcattggtcaccgtatctcccacacgggtatctttaacatttttcaggctggccgtaatatagcctaccattccggcgctcagttcttcacagggaataaactgtcctgcgccgaaatatccaacctccacaacttctgccgtggctccggtagccatcatacggatcggtgtacctttccttacgcttccctcttttacccggcagaaaacgattacacccttataagaatcgtaaagagagtcaaatatcagtgcctgaagaggcgccgaagcatctccctccggcgctggaatcttctccacgatctgctctagcacctcttccacattcaatccggtctttgccgaaatcagcggcgcgtcctcggcgtcaatgccgatcacgtcttctatttcttcttttacccgctccgcatccgcacttggaaggtcgatcttgttgatgaccggcatgacatccaggtcatgatccagcgcgaggtatacattggccagcgtctgggcctccacgccctgtgcggcatccaccaccaggatcgcaccgtcgcacgccgcaaggcttctggacacctcgtagttaaaatccacatgcccgggcgtatctatcaggttgaggatatactcctccccatcctttgctttatagacagtacgcacggtctgtgccttgatggtaatcccgcgttccctttccagatccatattatcaagcacctgggattgcatctcacggcttgtcagcagtcctgtcatttcgatgatccggtccgccaaagtagattttccatgatcgatatgtgctatgatacaaaaattacgaattttactctgatctattactgacacttttattcctccaacctttctttatctctttgacacggaagagtattttacaataaacagctcaaccgccagtacatccgtcagacgccctgttttcacgcgttcttcaatatccgcactgtcctccataattgcgcggagttcgctgcttctgaagtgttttgcctgatccatgtatttgcccgcagcaaaaggatgcaggcctgccttggatgcgatttcttttctgccataccccttctttagcagatccttaacctggtgcagaatccgatactgccgggtcatcagatacagaatccgcattggaggttctttcagagctaccaattcatagtaaagctccagcgcccgctcctgcctcttatccgccactgcattgaccatatcaaaaatatggttggaaatctgcgtcacacataccgcgtccacatcttccggcagaatgctgtctttctccagtgtatagcagaatagtttttccagttccttctgtatattccccatatctgtaccgactttattcaacagataggtcactgtagactctgatatctgcttattctccttgcgcaccatccccagaatccactttttcagcgtcgactcatcctgaaacggcagctctgcaatatgccctttcgccttcactgctttaaacagcttgctgcgcttgtccacttcattttctacgaaaataaaaaatgtagtatccggcatatccttaatataatcggccagatctgcccccgcactcttaaagaatccggtgttttcgaataccagcagccggcgctcagcaaagaacggcagagtttcagccagatcaatgacctccctgacatctacgcctttcccttcataataagcgtaattcatcgtatccccgttcgggagcattgccttcgtaaaccgatccttatactgcttcttcagataattttcttccccgtagagaagatatatctgcctgaattgtcctgtttttaaatcttcatttaaactcttcataacgtatctattatataggaaagttctcgattatgcaaaatattttccggcatattgtaaaataaatgtaacggacgttactatgcacggccataggccgtgcataataactagtataactcaaagtaaatagcacaatgtttcgccggtctgatttcccgaaagcacagatgcaaaagcctcagcgtagccccactacgcctgcgtatttgcatctgcactctcgaagaattatacgcagcgaaccatcatgctatttactttgatctatactagcggactgtaacagtttaggcccgcctgaacctttacacggacttgttatttatgaaacgatgtgccggcatataatgaaattgccttttcgactagtgcattcagggaaattccttcgttcgctgcgcgcaacgacgcttctctatgaagctccggggcgatccgtatgttaaaactccccttatagctcttatccggagcaatgtgtttactttcacagtctttcagatattcatctaccatttcctgaaaagacgctcttaattcctgcacactctcgccttcaaaggtaaccagtcctttgataccaagtaccttcccatgaaagcattgatcctcatctgaatattcaatcgtaccataatattctttatatttcatgcagttacccatcacaattcctccttgcttaataagcgaatcagctctcttaaaacatattttttgacgatgtttcccggatgcggcctatgtatatagatggggacccctaactccctgttataatactttacagctgagccgctggttttcccggtttctacttcccggaacccaaaatattttaggagctgtcttagctcatcgtatgtaaaatcactgggaaccgtatatagacgctttattaatttatttttcttactcattatttcctcctttattatataataatgcagctgtatttgcaactattttttagtcgcaaaaatcattaaatccttatcatttttttaatagtttatagatgttctccagtttctatattcaacggcgaaacgttctcaaataggcctcaatctctgcgctttctccatcggtcgccagcattaccgcaccgcattcctgtgtaccgtatattctgctccctgtctcttccagcttttctatcgtctctttgtggggatgcccgtaccggttatcaatccctgatgatatccaggcggtaacgggcagtgtctgttcaagaaatgccctggaactggaatttttagacccatggtgcgccactttcagcacgtcataccggcggagccctccctgttccagaagtttttctccttccccctccacgtctccggtaaacaacatatcaaaatctccgtattctgcctccaacaccatggatgcggcgttcccggtctcccccttgtacgctgctgccggtgctttgcaggacaattgaaaatttccttctgtcattctgtcgcccacatccatcactacgactctcgtattgttttccgctgcttttactgccagctttttcagcgcatcgtcctgtactctatccggcggcagaaccagatttcggatgcggattcccagacgctggttctccagcagttcctcgattccgctcatatggtctgtgtctccatgagagataaagacataatccagcgtttttacgccctgggattttaaaaagggctcgatcctgtatttacctacatcggaaacatcgctgctccctccatctataaaatactgcatcccctgcggcccttttatgtacaagccttccccctgccccacgtcaagcatagtaatccgaagggttcctctggtatgataggtccgcatacatgtgataaataatgtgccgcaaaggaataagagccctgcgccccccattagctttatgcgggaggatatcacgaacggtaaagacgcgcgggatgtccccttttcttttattgttttcagccggtatccgacagacaaaacaaaaataagagaatatagtaaataaccatccaccctttttccggctgccccgatacaatcctgcttaccggtaattccatactggctgaacaagctttttcgtataaaaacaggacccccttacagacctgcagcagcactgcgcctgcccgtacggatacaatggccgccagggagccgatcacaccgcttcccagcaccagggacatcagaggaattacaagaagattcaggataacggaatacatagggaattcaaaatagaaatacaacataaccggcagcaatgtaagattgacagatagacttgcaaggaagctgctgaagattttccgacctttctttccccgcaaaaaacaggattcaagacacggattgacggcggtaattcccaacagcgcgccgaaggaaagcagaaaacctgcgtccagaagaaaaagaggctgccatgccacgatcactgctgccgcaagcgacaggctggtcggcatatcgtagtctcttccggttatatctgcacccattctgacaaaatacatgacaaacgcccggatactggataccccgcagccgatcatcagtgtataggacagtaagaaacaaattccaatccctccggctatgctaaaaggcagaccggctctgcgcaataatttatacagcccgatgcctaaaaaggacatatgcaaacctgaaatggcgagcgcatgcccgattccgcttttctgatatagttctttcagctcactgtccagtccgcttttgtcgcccagaagcatagcgctcatagtgttcccgtagtattctcccatgcattcgatcaggagcgtcttccatcgctccctgagcaccgccagattttcccgtatccgatattcttctgcatccagtatttttacgtcgttcgcccatacggatacatggatcccctgcttgcggtaataaaatttctgatcaaaattccccggatttctggcttcttggaagacctccgccgtccctgtgatctgtatttggttcccgattgctgtgtgatgttctgtttggatataaacaagaatttttgattcctgaaagatttgattcttcagatggacaagattgtccttaagatataatactctgcagtttggtttctcttccctgcgatagattgtcccatccagcacgactttttctttgccgccgatcccggactccagccgggtgggtttccagtccggtgctatatgaaacccgcccgccaggacagtctgtattccgagaaaaagaactgctgccgcacatagtggcctttttatcattcttcctccgcattttctacccagcccatatcccgctgcagtggctgggtcaaatcaaccgcatccttgtaagatatgttcttttctccgtttaccgtaatctgcactttactcgccgttgtcccctctacaagagagtttactatggaataaatggtgatctccggtttgacatccactccccctgtcaagaattcatcatccagattcacataacagatcccgtcttttattgtcaccccgagaaggctgacggccggattaattgtgggatatcctgcattctttttcggtcccttcattagcttttccacgatcaacttctctttcgacatattgctgctgtattttacgtccatatgctgctctgtcagtttatcacctgtctcatttgcgaagtatagtgtcagcgtgcccgtttgataagagttcagtgaggagccggtgttctgcacaaaatcgtcttcattctgatatcccagaatctgtccttcactgtccctcagatcctcaccgtccactgaaatccagagaacactgattccttcaatccggatcagagactgaaccactgccgccctcaccagcttttcctcaagcggcggaatatccgtataacgcccgttgaaatcgagatacagaagttccccttccagcttacaggtattcacttttaccccttttggtatcggcgcggtataatcaatatcttcggacggcttcgccagttctttcagcattgcttctgccgcctggagcgggtcattgcttttaacctcataattcacttttatcaggcctgtccgatccccattcagacaatagataaaggaactgtcatctttcactgccgtccgctttgaacatgcagacagaaggagaagcaggcagaaacagacggttaacaggcctgcaattcttcttttcatattggtactgcctccttctaagcaacataggtcagcgggatccgtaccgtgaatgtcgtcccctcaccctcgctgctgtatactttgatggatccccggtgcataatgattgcgtttcttgtaatggcaagtcccaggccggtaccgcccatctcccgtgaatgggacttatccacccggtaaaaacgctcaaatatatgctgctgatcctgttccgggataccgatccctgaatccgcaacttttacatagaaatatttgtggtcagcattaagagagacatgaacccatccctcttcatggttgtatttaattgcattctccaccagattagaaattgccagagtaagctttacctcgtcaatctctgccgtaaccggacggaaactttccagaaccacctcaacattcttcttttctgcaatcggcttgagcctcttcagaatcagttccatcagttcgttgatattaaccgtattaatattcagattcttggcagtcttgtccatctttaccagagacaaaaggtcagcaataatatcattctctctgtcaatctctttcgcaatgtcccccatgaactcctgatataattcgatcggaacctcttcctgcgacagaagggaatctgccagtaccttcatggatgtcagcggcgtacgcagctcatgtgatacgttggatacaaactcttccctggattcatccagctgcttcagccgcccaagcatcttgttaaaagcttcggagagctgcttggtctcggtaaatgtattcacatggagtacttcatcgtcatacccttcggacacatccgcaatagatgctgtgatccttcgcagcggtcttacaatcagatccgcaataaacaggctcagtcccagcatcagtatgaaaacgattcccagaatagcgcttccttttgtgctcagaatcttcaggctgtcttcaatcgtatctgtcgatacactggccagcatgacgcccgatatctcttccgtatcccccgccataatcggcgaggtcacttctatgtaccggttcgctttatcataataattcgcactgctgcctttcatacagcggatgacatcttcggatacgattgtcttcccttcatccaggctgtaggtgtcctttacgacacgcagctctttatctacaatcattacccgcccattatatatattcgttaactgcgtcaaacttgcattgataacctcggatgaagtatccgccagataattatagctgttcagctgattgcttagaattgtacattgattttgtatatccgcggttctaagggatactgcacgcgcctcgtatgccttgattatccccctgtatgctgcagcacagggcacaatagacacagcaagaagcagcagtataatacagaaccgcaggctctttagaaatttactatttagattaaaatgaaaatcacccctggaaataataaccaactccccactttgtatgtacatattttggctcgctcggattcttctcgatcttctcacgcaggcgtctgatatgcacatccactgttcttgcatctcccggataatcatatccccatatcaaattcagcagattctctctgctgtataccttatttggattcattgccagcagttccagtacatcgaattccttcgccgtcagattgatctcccgttcaccgatgaacactctcctgctctcgcagtcaatccgcatggccccttttataatgaccgtactgcctgcaggctcttcccgcttcgccgttcgtctcataatggcctttatacgcgccttcacttccaggatgttgaaaggctttgtaatataatcatccgccccatactccaggccgagaatcttgtccatgtcttcactcttggctgtcagcatgacaaccggcatgtcggagaactccctgatctgctggcatacctgaaagccgtccagcttcggaagcatgacatccaggagaaccagatcatactcgcagtttctggcgtattccagggcctcctcgccgtcataggcacagtccacttccatgccgtcttgttccaggctgaaacggatccccttgactattaatttttcatcatccactactaagatcttcttttcgctcatactcctctttcccttactcccgcacgctgaagatccgttcatccaccatgcccgtagaccataaaaacctcacgggccgagtggacaaatacctcagcttactactctgtcttttattttattaaatactccctctttgattccctcaacctgcatcagctcttccacggtctgaaatccgccgtttgcctcccggtaggaaataatactgtcagctttggcatctccaatgccgggcagtgtcttgagttcctcttttgcagccgtattaatatttatctttccctggttgtccgttcctgttacttgtgccgtctggccgtctacaatccctttttccagttcctccgccgtcggtatataaatgcgctccccatccgttactgtactggcctggtttaaagcttcccctgctgctgcatcattcaagccgcctgccagtgcaatcgcctcatatacccgcgcatcaccggctaattcatatacccccggagcattcacggcgccgcatacataaacgaataccgtaccgggatcttcccgctgtacggcatcttctgatgcctcttctgcctcacccttttcctgctccagttccaactccgataaagaatctgttctttctcttgcgcatcctgacgccaacactcctgcggtacaggccgccaagaaaaatacacagaactttttaaccaatctgtccttcataattccctcacagtcttcgtgctgtttgagaatcccctcgccggacattaatattgtaacgaataatagtttaaattacaatacatatttttacgtttttgttacatctttattaagccaatgcagttattcccactggaagatcgcaattccgatcagcgcaagggcaagtccgccaatttttctccagtccagcggctccttatccaccccaaacagtcccagcagctcaatcacatatgcaacaatcagctgtgcaataacaatcaaaagggccgcttttgcagggcccagtgcagacatactttttatgaccgtccaggtaatacctgcaccaatcacgcctcccagcagcatatatttaggctctacctttgcaatcgccgttatactgtcgcggcctgtgataaaccatgcaaccgcacataccaaaaaagcggacagctgtacccaggcattgccgacccacattcccgtcgtctttgttacctgtgtgttaaataccccctgaacgctcatcaatgcacctgacagcagtgcaataaaaaaaccaatcatatcctcatacctcctgcagtttttcttctgcttttctatagtatgtcctcaatgaatggtttttatttcgagtatgttattattttccgtggtataggaagggatctaggttagtccggcaagaacacgttcaaaccgctccaccatctcatcgatatgctgttcctccacaatcagcgggggaagcagacggatcacattgctcgccgcctgtatcaccagcagcccttcttcgacagctttctgatttactttggccacaggtctgtcaaatgcaagcccctgcatcagtccttttccttttctctgaagaatacagtcccatttatcagtcagttcgtccaggcgttttatcagatacggggaaatgtcattgacgtgttccagaatgtgctcctgttcaaagatctctatgaccgtcttcaccgcggtacatgccagcgggtttccgccataggtagccccgtggtctcccggcttcagggagtaatccgcaacctcctgggtcatcgcaaacgcacctaccggtattccgttgccaattgcttttgccatggtaagaatatccggttttaccccaaatccctgccaggtaaacatagtacccgtacggcccataccgcactggacttcgtcacagatcatcaggatgccgttctcatcacagatccgccggattccttccataaaatcctgagtagcaaggttgatgccgccctctccctgcagcggctccaggataatggcgcatgtcttttcatttaccagcgcttccacactgttcaggtcgttgaattttgcaaatcgtacgccaggaaccaccggctcaaatggctctctgtaagaatcatgtccggtaacagaaactgccccgaaactccttccgtgaaacgaattctccattgcaataaattcgtatctgccggtctttttcgtatatgcatagcgcctggctgcctttaatgccccctcgttggcctcactgccgctattggtgaaaaagaccctgtccatgcctgatatgcggttcagctcccttgccgcctctccacaattctcatggtaataaagattcgaaatgtggtagatcttatcgatctgcgtcttcagcgcctcattcagttttttatggctgtaacccaagcctgtaacggcaaatcccgcggcaaaatccaaaaactttctgccttctgtgtcataaacatacattccctccccatggtccagggctatagggaaacgattgtaaacatgcagcaggttctcctcacctgcctgaatcttactgttcaccatgataatacctgctttcctctccgtttagtattgcggttccaattcccttgtttgtaaagatctccagcagcagacaatgcggaatccgcccgtccagaatatgtaccctggaaaccccgttttctatagcatcaatacagttctgcagcttgggcagcatgccgcctccgatatagccatcgttcatcaactgctgtgcctcatccacccggagttcggagattagcgtctttggatcatcaggatctttgtatactccctcaatatccgtcagaaacgctagtttttccgctttcatcgctcttgcgatagcacaggctgcatcatccgcattgatattgtatgtattgtattcatcgtccattcccaccgggcagatgattgggagaaaatctttttccaaaagatcatagagaatctctgcattcacccttttaacttctcccacgaaaccgatatcctctccgttggaaagctttttatctactttcaggagtccgccgtccttgccgctgataccgattgcgcgcacgcccagctcctctacaagctgtaccaggcttttattcaccttgccgagtaccatctccgccacttccattgtctcctcatccgtcacacgcaggccattgacaaagtgcggctccatccccaccttgccgacccatctgctgatctcttttcctccgccgtgcacaataatgggcttaaatccgactagcttcaaaagcgtgacatcttcaatcacctgtcttttcagcgcctcgtccaccatcgcgctcccgccgtattttaccacaattatcttacggttaaagcgctgtatataagggagcgcttcgattaacacctgtgctttttccaggtactgctgcatattctcgttcataatttcctccttactgcagatacggtatactcttaactcctgtaatctgcattgatatcaatatacccatgggtcagatcacagccccatgccgcagcgctctcttccccttcctttatatctgccgttgccgtaacctcaggctgggacaggatctcggtcgctttttcttcactgtaagcgactgccgttccattctctataatctggattcttcccgctttgctctcaaaatacagatccaccttttccggatcaaactgagcccctgaataacccattgcacatagaattcgtccccagttggcatcatgtcctgcaatggccgcctttgtcaggtttgaacatacgatcgatttggcaagcagctttgcctgctccttcgtggatgcgcccgttacctttgcttcaaacaacgcggttgcaccttccccgtctccggcaatctttttggccagacattcatttactatatgaagcgcttctgcaaattttacatagtcatctgttccatatttaatcttatcgttttccgccatcccgtttgccagaagcagaaccgtgtcatttgtagacgtatctccgtccacggagatcatattataggtatcctccacatcggtgctcagcgccttctgcagcgcctttctggaaatcgccgcatccgttgtgataaaagagagcatggtgcacatattgggatggatcatcccggatcccttcgccatgccgccaattgtgacggtctttccgcctgcctgaatcgtaactgctatttccttctcgattgtatcagttgtcataattgcctttgctgccagagtcccgctttcaattccgggattcttatcggccgcaagctttgtaatcccatctttgagcttctccatgggaagctgcattccaatcacgccagtggatcctaccagcaccccctctgccttcactcccagcgctttcgccgcggcatccgcggtctcttggcagtacgcatatccctcttctccggtgcaggcattggcaatgccggaattgacaaccaccgcctgggacttaatgccgctttccacaatagctttatcccattttacgggtgctgcttttaccacattcgttgtaaatgtccctgctgccttgcacggcctttcactatatatcagcgccatatccgtcctgtcctgatacttaatgccggctgccgccgatgctgcttcgaatccttttgccgcggtgaccccgcctttgattatttccattctgttttcctttcctgcgtaatctttttgttacgcaatctgctcattttttattcattatcttatttaatccgctatatattcatttgctgctcaacaggcatgtcagatgaatcgaatgcctctgatatgtgtacgtctattattcattaaattgtgtacttctaatgttcattaaatgcggtaatgttcttctcattcaacacaaaatcataataattcaaatccagccgttctgtccatccgattgtattccagaatgcattccccacatcgtttttggtaaatgcaatcaaagaaactttgctgatctcctccctgcgcagttcttccatggcctttacaaccatagcctttccaatgccgcgcctccggtatgcagcatctacacatacatgatatagacatccccgccgtccatcgtgcccgcacaggatacttcccacgatcaggccgtccacttcggccaccacgcttgttgttggatttctcttcagaaacctggcaaccccctctctggaatcgtcaatgctccgtagtccaaagcccctgatttttttccaaagggcatacacgccgtcataatcctctattgtcattgtccgtaccattttttcttcctctcgatctctattagagcccatccctgttataatcgggctgtcccagccattttccgccccctgaatcgcttgcgtccaggatgtcttccgttcatgcgcctatgggaacatcggcaccagttccagtccttcggattccttcaaaccgaacatcagattcatattctgaaccgcctgccctgccgcgcccttcacgagattgtctatagcccccatcataatgatgcgtcctgttctgtcgtcaatcttaaagttgatatccacatagttgcttccttccacccacttcgtttccggccagattccctccccgagtacccggacaaatttctcgtccgcataatatgtatcatatacagcttttatatcctgacacgttacattttttacaagttttgcatactctgtggacagaatccctctgttcatgggtacaaggtgaggcgtaaagttcagaaccacctgttcacccgcagcataacccagctgctcctcaatctccggcgtatgtctgtgcgcagccacaccgtaaggcttgatgttctcattcacttcgcagtataaattaggaagcttagcccccctccctgccccggaagttccagatttggcatcaataatcagagtgctcatatcgatcagcccctcttttgccagagggtacgccgtcagtatggaacaagtcgtataacaccccggatttgccaccagcctggccttttttatagcttcccggttaatctcacaaagcccgtataccgcttcctcaataaaacgggggcttttatgctgtatcccataccatttctcatatacggatacgtctttcatccgaaaatccgcgctcagatcaattatcttcactttagacagtatgtcctcgctgaccagcgatgcacacagcccctggggtgtagcagtaaagataacatccacctgctccgcaagctcatccatattatcatccatgcagaccgcatccacaatctggaacatattctgataaacatctgcatattttttatctatataacttctggatccataccaaacaatttctgcatctttatgtgccgttaaaatcctgacaagctcaccgcccgcatacccggtagatccaataattcctactttaatcatatctatctcttcctttcacgcttctagttcataatcatataccactttttcaatgaagtaaagtgtttgcccgttttctcaatcagaaatacatatcgactgcaaaaatgtatatatcttatgcatgaataaaaataacacttgcataattatacatctatattgtatattatgcaacccccatccagaaatatttttaaatcgggatttagtcggcaagcttcagccttgtcgacggacggggacgcttcatgacagggaggccggggaggtgctggggctgtatatgccgttgcgatatgcacccatgctgctaagtgtttctagaacagccgatgccggataggcgggtacgctgaacacatcacgggaaatctgatgatttcccgcgctgggttcagtaaaaacttgatttggagatcaagtttttccccgcctatccggcatcggctgttcaagaatcactaagcgcactccagcatttcgcaacggcatatacagccccagcacctccccggcctccctgtcataaagctggctcatccaatcggcaggaaagctcgccaaccgggtaggatcccggaccggggcagcggatgggacagaattggcgggactttaatatagattgtaagttttaaacgcttttttaccttactgattactttacgccaacctaattattaataacttactggggctatcaaatccacaccaattcaataccatccgccccgggactaaagcccgttgctaaatcccgatttagtttctaatctgtccgttcccaaatataatatattttgttgttgtcagcgcctcaagccccatcggccctctcgcatgcagtttctgtgtactgattcctatctctgccccaaaaccaaattcaaacccatcggtaaatctggtggatgcatttacatagacagccgctgcatcaatttcatcctggaatttaagcgcgtggtcatagcactctgttataatagactcggaatgacctgtgttataagtattgatatgccggatagcagcatccagtgagtttaccacttttatggaaatcactgcgtccaggtattcggttccccagtcttcctcatctgcggggataatatccgcactgtaaccgcatgctttctcatcccctctgatctccacatcgtgcatttttaaacggtttacgatcatggggatcacctgggctgccacatggtcatggatgactagcgattcacaggcattgcatacacccatgcgctgtgtttttgcattctcgataatgtctgtggccatgttcagatccgcacactcatctacataaatatgacaattcccggtgcctgtctctatcaccggcacggtactgttctgcacgacgctggcaatcagcccggcgccgcctctcggtatcagcacatcaatgtatccatgaagcttcatcatttcatagacggtctcccggcctgtatcctccaccaacaggatcagatcctggggaagcttctcttttctgaggccctcttttacggcatgtacgattgctttattcgaattgattgcatcactgcctccccgaagtatgaccgcattccctgttttaaaacacagtccaaatgcatccgcagtcacgtttggacgagattcatatataatcccgattacaccgagcggaactctcttttttccgatacgcaggccgtttggcctgtttttcatagagagcacctcaccaaccggatcttccagcgccgcgatctgtctcagcccttccgccatatccataattctctgctccgtcaggcgcagacggtcaaccagagaacttttcattccgttctcttcagctgccctgacatctttttcattttcctctaaaagccgttctgtctcctggcataattcctctgctacagacagaagcccacggtttttttcctctgttcccagcgctgctgcctcccgggatgctgcctttgccctgttacccaatgtttccatataactgcccataactgcctcctatcagattcattgatactcccatagtctcctgttccatatgatacatggattttgtctcgtcttctttctgattctctttcttctgtttttttgcctgcctgcgatattgtgcccgttccggggccaattcattctttagttcgatcccgtgctctctggataaaaataaggtaccgatcttcttaccggccataatgtcattgatcgtataaatattcctgccgttggcgatcaccatgtccgcaccggatgcggtagcgatctttgcggctccgatctttgttgccattccgccggtacccatatcattggaggcaccctttgccattttctccagttcctcatcaatgcccaccactgtatggatgaatcttgcattcgggttcttcttggggtcatcggtataaagtccatcgatatcggacatcaggatgagcagatctgcatccaccagcttcgccacatatgccgcaagtgtgtcattgtctccaaagttaccatatgacagttcatccacagatatggcatcattttcatttacaataggaactaccttcatacggaacagttcgtcaaatgtctggcgggcgttcttgcggcactcctcattggtaatagattcctttgttagaagcacctgtgcagtcagctggctgtattcgttaaacagtttttcatagatcatcataagtcttccctgcccgaccgccgcgcatgcctgcttggcagcctcgctctccggcttctgctgcagccccagcacatttcttccgattccaaccgcaccggaagataccacgataacctcccttcctttgttgcgcaggttaatcagtatcctcacaaacttctccagtttatcaagattaatattaccagtttcatcatacgtaattgtagtcgttcctacttttattacgattcttttcttattttgcagaatttcttttctatccatagcgtttaaccttcctcattttccttcttgagagtgctctgcacgttcctgatatataacaaagtgtgctagcccacctccgctccccacccacctcacttcagaggggcttgcacactttggcgccgccgcgttgccgccttgcggctatttaccatatcgcagcgtgtgcatcccccggagggtttttatgatataggaaattccaaaggaattccctatatcataaaaaaggagagccggatatatcttccgtctctcccgttcgatggctttcctgtaagcttttccgccccggaaacctcattcggttctcctaaggcactctacagaaaaaggatggaagcttattgccatactcccatcctttgcattctatccatatcaaacgatcagcacaacgatatcctcttaactgtcattattcatttttatactatgcgcataccccaaggggacttggaacgcacggcataaaaacaacgctgtcagcaagcggcagagtctgattaaactgattcatgatgtcaagactgttatgttttgctttcatcactacaactccaatcattcgtgtgtatgttagttactcctgttttgttttattttactcacatttcctgatttgtcaaggaatttgggggattttctcatgtttccaaaactagaaggcagtctaaatgaacgccagtctatcgccgtctctattctattttcaaggtgaacacaaaaatcattaactggttatagatcccaaatatttttcctattttttcctcaccgggtgacggattaccgtctttaaattctctggttttgtctttctcgggtcacccagatagatctcatgatgacgtctcagatccgtaatgtcggtaatatatccattatcccggatatattcttccatctttgcgatcgttgcaggctcatcatcataggggccaaaatgcatgacctgacagcatagtccttccctgtaccgttccagcctggtgttggaaaagtccagttccggcttctttttttgaagctcacccctggcccattcaaatacttcttccgtcacaaattcaggctgtcgtatcatggaggtccagcagaacttgtctttgtccgtgatattcaatccgtcgaattccgctccttccacactccacaggccttccagaggcggcaccacatattcaaaataacctgccggctgatttcccttcattttgctcatcttgatcgtataggaaaggccgtacagaatctccattgcctgcgcataactctccgatgtgtttggatttcctctgccatccgtcatgataaataccatctcaggtatctcaatgacagaaggtgatttcttcggaaaatacaattttttttcagatttcttataatccactttatccatgattccttgccttctttcccgccgttttttgctttggttggggcagttcctcacaggttctacttaccagctcttttaaaaaccgggtatcctccagatcttccaccagatacatccccggagttccaccatgcggagcagcaggttctgcatccggcagcatttcgtgccctgcctgcgtcatcttgacataaaactggttgtcctccactgtcccgaaaaatttgccgtcgcaccaaaggccatactctccaaacagctttttataacttatatttcctgcttggccaatctgtccggccacatattctacgtattccaaactggatgccattttatttcactcctatatacatatgaatttcagcctgctccatatcactattctggtattcctcataatcacagacataggtcctgggcagatctatttcccatagcttctgccagaactttgccactgcctcgtgcagttctccttttacaatgaatctggcatacttcccggccggaatgacagtaaccaatgtcccctccggcaattcccctgtcccgtcggtttcacaggccaccgtgattgtataatctcccttttcatcagcctcatattctgaataaatccccagtgccttgccatccgtttttcccggaatcatgttatagattccttccccataaaaacgctgccagagccctccgatcacgtttcccatatctggagacgcattgttcgttctggcagccagtcctgctgctatcttttctttcatatctaagatttcatattccatgtttatcttcctctttccttttattgataataagagtttaccagagggaacatgacacctatatgtcatatttgattttcatttaatcccgatatttttcagccattctcccaagcatttcccgcattttcctgcggagtccgaccggttccagaagctgagccctgtcaccaaagctcaaaagccagccaaacacgctttcctgatccataaaaccaaactgaaaaagcagcattccgtcgggctgcacctggaagctgtcgatcccatattcttcaatcaggcgccacttcatggacgggtcaaacagtgccttcacctggagctgtgccggaaaaaccgcctcattctcaatcctgaactcaggcaggctgcgcccttcgaaccgctctcctgtggttcttaattccagtatccgattcaacttaaacatccggtaatcctccctgtcaaggcagtatccccagacataccaggacgcccactggaagacaagcagatacggctcaatttctctggtgctgtcgccgcccgggccataataatcaaactggatcttctcttttctgtcaatcgcagactggatcagttcgatcttcggggccagagacaccttataccaggaggacagatcaatcacgatatgctgatttgatttcagcacgcttgaattgcccacggacagtttctccatcagctgctggtacctgctgcttccggccacactgtccaggcttctcagtccggccagaatggcctgcatatccgaggaagtaagcagcgtcctgtcaatccggtacccatccataatggagataccgcccccgcttccctgtgtcgtcacaagcggaatgcccgcctggcacagcgcctcaatatcccggttgatcgtccgcctggatacctcaaacttttccgccagataaggggccgttaccttctcctgctgaagcaggatggataaaattccaatcagtcggtctatcttcatctctctttgctcctctgttatatcttattctgcagttatttcatgttctgcagttatgctgcaggtgaattttaatgggctggatgcgtaacagttcaggcaggcctgaactgttacacggaataccttttggttatacaatctttacacccagtagctttgctatctccactgcctggaacatgttgatcttcatacctgctacttcccggtaactatccgataccatgatgccctcaatggtactgtcggaaaaatcaatccccttgagtccggttctgaaaaaatctacctttgtgaaatcacatttggaaaagccggtcttctttagttttacctccgaaaaaaaagcctcccggaaactgcacgtctgagcaaagcagctctcccaaaggctctgcccgaaattagccatgttcagctgtgtatcctgtaagcccgtttttttaaagacagcaaggtcaaatctgctgccgttacctttgcattcgataatcttagtatctttccaataacttccgctgaatatacagttggaaaaatcacatttttccaggcgggcctgataaaagcccgcccccgtaaagtcgcattctacaaacctgcacttttcaaattttactgccacaaattctactttgtgtatatccgctcctgtcactgtctcatctatataactccggttttcaaccggcatctcatcctgtctcgcacaggcaatctcttctgctaaaatatgactagttcccatttactcctgacggcccatttcctgactcaaatggtattttgcctcctccgcattctttttttctgtgtacactgcataagtcgcgttgcagttttcattttctccgattcttcccagcatctgattattcctggtggtgtggcgcacaatctttgaacggtaacggatcttatggccgcttagtatcctctccgcccttgcaaactcgcccatatccatcgtaaaaaagacttctgttctgtcccatataggaatcccgccaatcagccagaaggtaagggcagtcaccaggattaataaaatcgctgccatatatacaacggtgaaatcccgtgcgcttccggctataaaaatactcgtcggaccatcggatctgccaatcacagacacagcggcatttaatttattctgcagccagatacagatcgcgctgattacaatccccactccgctcagaacacttaagatccaaagtatgatttttcttgttctgcccatctcatcctcctgccttctttcgttgttatattatttgataacactacagacaggtctgcgcatttactgcgcagaccgtacgaaaacatggtagttgcaggcatccaggtctccgcttcgatccgtgctaaacgtgcgccactggcgcacagcacactttgccgcaggcggatttcaatgagctggatgcgtaacagttcgggtttgccgcctagactattacattatttacgtacccgtgcttctttatatatcttataaacatcttctgcatgcagcgccttcaagcatcccacggtccgccgcccccagaaacaacacttttccgccatctccttcatctgtgcgtcggtcgggtctatccccagttccttcagagacgcaggcatatttatagaacggtaaaatgcctccatagcctcaattccctttaaagccgtctgcatatcgtctccgcagtcagccgctcccataacatttacggcaagctttgcaaaccgcccgggcctttccgatacgacgtaccttgcccagctgccccacactgctgccagtccggcgccatgtgcaacgtcaaacatgccgcccagttcatgctcgatctggtgggaggcccagtcaccgccgtccgtaccgcagccggtcagcccattgtgggaaaggctccctgcccacatcacctccgccctagactcataattctccggatccttctgaagaatagctgcatgtttcataaccgtgcgcagcaaatgttcgctgatgccgtccgtcaaatccatattcaccgcgcggttcagatagcgctccatcgtatgcatcatgatatctacgcagccgctcatggtctgatactccggcagcgtcattgtcagctccgggttcatcactgcaaaacgcggcctgctgtaaggactgctgtacccccgttttatccagccttcttcatttgttatgacggaggagtcgctcatctccgatccggccgctgcaatggtgaggacggctcctacggccaggcacgcctccgcctgtctcttcctgtcataaaaatcccatacatccccctcattcgctacaccatatccgatcgcctttgccgaatcaattacgcttccgcctcctacggccagaataaagtcaaccccttcctttttgcacagttcgatcccttcatatataagggataagtgtgggttgggtacgacgcctcccagcatagtatatgcgatcccagccttctcgagagaccggcagatccgttccagcagtcctgtcctcttcacgctcccgctgccgtaatgcacaagaacctttgtgcatccatatgcctggatcagatttcctgtctcttcctccgccccccggccaaacacaaccttagttggggtataatattgaaaattgttcatattcaggttctccttatcatttcttttcattaatcatctattcattgacgatatcaatctggcacactttcatagcctccagcgcctgcctgtgcgtatccggcgtcaccccggcacaacaggatgcgtccacgatcaccggaacatcgggcatgtatgcctttaagaggagtgcattggatatcacgcagatatctgtgcagacaccgatcagtgtaatactctctataggttcctggtatatatgataagctgacagcagctgccccagccctacgctgccgaatgttggcttatcaaccggctgctccgtgagcagcgcggcgatctccggatggatctgccagcctggtgaattccggatacaatgtataaccggaagcttttccccttcctgcgtgtccagatacccctcctcgtgggtgtctctggttgccaggatcctgccttcaaatcccctgatcttctctgtcactttaggcacgatggcctgcgcctccacagttcccagtgcgccggctataaaatcattctgcatatcgataaccactaatactttcatacgcttcctcctcttctttcctgaccgtcaggccgctcgtccgggaacagatcaataatctgctcttcttccacaaggcattccagccctgttaagcagaacttaccggacatggattcccgttcctctttccagtaaggcttagaaaagcagggctgcatatcaccaccgtaccggcttttctgttccgtcttcctgccggcaaaaaatacggataccggcccggactggccgccgacaatggacaccgctcctttcttcttacctgaagccatacaggacattgatgcgccaaacttcaactgctcatcttttctcaaaccgggcacgatctctgccgttgcaagggaatactccagcctgccgtcgaatactcccggagcatccagtttctttgcatcataaatatagaccctgtgtctgacatgggtcagggggtggatgaactgcatacacccctcctctcccggagccgccgacgtctcctcgtccagaacatagatcttatgcttcctgtccacctccagcctgatactgcttagtgtgcaggcagtgaaatcctgctttgtctttacacaaacgcgctgacagaaaaaacacgctccctctgccagataatcggaataagccgccctgattacccggatcatgctgcgtgacttttcctcccggactaaaggcagatatcccgtactgcaaaaggatatatcctgttccttttctccattcagccagattccctttatggccacattctgatacggattctcctgcatgatcttctgtacctgcgtatcggagagcgaatctgctattttctcccagcctttatatttttcaaaatattcaaccatgtccgtctcttctactaccgtgagaatgtcaaaaataatcccctgtttaaagcagtatactgtggggacacagcgcgtcagtcccccctctgtaaatacagcatctgtatcctgccggaccttacatggtcttcccttttttgacagcccgatagatgtatcaaagtatacctgcatactatttcctttccgcatcaaagctcttatttatctgcccacctgcggcagttttccagtcggaacgccaagtttttctatcagtgaaatgattttatctcaggatagtattcaaattccgcttttccaatgatagcgtctctgtgaaggaacttgttcagccagtatctggaatcccaggaattggtgcggttatcccccatcataaaataagtgtccttcgggatctcataggggccaaaatcctcataggatacttcccgtatatagggttcttccaacataaccccatcgatataaacggcgccgtctctgccctcaatcttttctcccggcaatccgacaatccgcttcatatactccgtctccccatcatccggatagtaaaaagaaatgatgtcgcctctctgcggttcctggaacagataagcctggcggttgacaaacacacggcttccggtcatcaccgtattctccatagatccagatgtaacctgcgcattggtaatcaaagtcttattcagcagaaaagaaaacgcgacggcaaaaataatcaccttcgagtattccagaatctcatgaataatctccttccgggtccatacttttgtattatctgtctctttcatccttattctccttttcctgaaatatcatccgcaagcgctctcacgttctccgatattgttgcccagctggtgcagaacctgacggcactgtgcgtatcgtctatcctctgctgataacaaaaaacatacttctctttcaattgttccagcttctcatccggcatgaccgcaaacacctgattggttgtattttcaaccagaaacgggtacccagcactcctgcaggcattgcgtatctcgtccgccagtttgttagcccgctttccgattgtaaaatagagtccgtcttccagaagcgcctggaactgcaatcccaaaagtctgccctttgccagcagcgcacccttctgtttcataatgtagcggaaatcctccttcaggcccgggttggcaatcaccacggcttccccgaacaaagcgcccacttttgttcctccaatgtaaaatacatcgcacagcccggcaatcgttttcagatccagttcattgcctgcagcagaaagcccgtatcctaatcttgccccatccatatacaaatacagcccattcttcctgcacacaccggccagaagttccagctccgctcttgtatacagcgtacccatttccgttggattagagatatataccatcttaggctggacacaatgttcgaaactgtcatcttctatatgccctttataggcctcctccacctgctgtgccgtaatcttcccatccgctgagggaatcgccagcactttatgcccgcaggattcaattgcccctgtctcatgcacattaacatgcccggtttccgccgccagaaccccctgatgcggccgcagtgcagccgaaataacggtaagattcgtctgtgtccccccaaccagaaaatgaatatccagtgtatcattcccacaaagcctccgtataatctcccttgcccgcatgcagtacggatcttccccatacccatccgtctgcaccaaatttgtctctaaaagcctgtccatcacctttggatgagcaccttccgtgtagtcagaattaaaaaaaatcatcttccagtctccttgtttcaatctactctcggtaatttcgcagagtacgacggcatcttatatagatgcgtaaattggccttatgtcaatgggcgataccgattttttctccgcccgccactgccgctaatcttgtttaatatataaaaaaatatagataaacagattatactacgtctccttccctttttccatcctttaaaatggaaaaggaggataaaaatggctgagaatccggttcggatccgctgttatcagctttccaggcggggaacattatttctcccgattgaatgagtccaactgtaaagaatcgtgatagggcttttttagaagtgtcttttgcggtgtaacagccgcatcatccaaaaaagtacacagaccgcagagccaccgggcctgcggtcaattcatatgtttgcttttattttgattagcagctgttacacctcaattccgtatccaaaagagccctgtcgcgattcctcgcagcgcccccattcgagtaaaaaccgcttactccgtctaaagcttcttcttattgaagatgatacaggacagtgtgacacagatgagggttcctatgcatcccacgaccgtgggtttcagaaagagggtagactcgacctgtccctgcagcagcggtgtcccttctgtgattagttccatagggttgaattcttttatctttgggatcatgttcagcaggatctggagaacaactgctattcctgtaaacaggaggcatccgtaggaattcctgaacaggacgctgcccaggattgttatggacagcaggaagattccgtacagccatgtcgctgcaatggccgcatagaggccttccatgccggcatcggccctccagtagtaccatgtatatccataagctgttccaaaacacagcagataggctgcggtccagagcagggacgctgccgtgaactttgccaggactacggttcttctgggcaggccttttgtcagcatgtggattagtgtgcccctggaatactctgaggacatgatgcctccaaagagaatgactgccaccaacaggcccagctgtgatacgtttttgaagaactgcatccaggcgtccagcgccgttggggtggtaagtgcaatctccatcccggcaggcatgaactcactgatgatttcaggcatgtattttgctgccagagggctcatgattccaaaaaataaaaataccaggcccagaatcatcagtttatatgttcttgtaaactctgtaaattcttttctcgtaaatgccatatatgctttcattgtattgcctccataaacagtccttccaatgacggctccaatatttccatcctggagggcatgatctgggtctcattcagccctcggataagctcggactcggcctgctcaatgtctgccgcctctatgataatctgactgccctcctgccttgacgaagcaagcagttttttgaaagctgtctcatgtgtaaacctctgcagactttcttttctctcaaattcgatcagcagcgcatttttacggtgcatttcccgaatttcatccaacctgccttccatgactgtccttccgttgttcaagactgctaccctgtcgcagattctttcgacatccgtcagtacatgggtagaaaagatcacggtcgtcttgtcttggacctgctccataatatccagcacttcccgccgtccaaccggatccagtgcagacgtcggttcatcacagatcagcagcttcggctcgttgaacaaagcctgggcgattccaagacgctgcttcatgcccctggaaaatccgccgattctctttttaacgcccttcagacctacaagctccagaagttcttctgtcttgagccggatctgtttctctttcatcccggttatttgtccacaaagtcttaagtattccactggcgtcatatagctgtagaattccggaacatcaggaagatacccgataaaacggtttgccgcgttctccccatatacagacttttctccaagcacatgaacctctccgccgtccgattgcagcaggccaagcacgattttcatcgtagtagtttttcccgctccgtttttgcccagaaatccaaaaaccgagtgttccggcactgcaattgataatcctccgagaacctgatgggaaccaaattttttcttcaagccgttaatttccagtacattcattcgtcatcccctcttccaaataagaaataaacaataggacccgcaatctgaataaacaccacgattacgatccagaccacccgattgccaaaccggtaatttggatggcgcagcacatgaatcagagccgtcaccattaaaatcagttctataataatcaccggaagcaaaatcggaaaatattcatataaagtattcatctttttactccttttttgttgttattcttcgttcttcctgtccatgccgctacaaaaccaagacaccatggtactcatgaactgtcttaatctcccccgctgcctgccaaaagcgaggtactgcacagttaccgtcttaaggccgtctccagccctttatcatctgcccctgctgaattcctccagtcttttcataatccgcttataatgtggattatcactcaggcatgaaaacaatgggtttgcctctactgcctgataaatgctctgtcggatggccgcatcacctcggggagcatcttttccaagcgcaagatctgacagccagccgtccactttatcaaaatagtcatctccatgtaatttgatcggtgtttcctgcatatacacacagtcggtatagcgttccagcatttttacggcttcttccgggtttgctgtaatacagtaatactgggcggatgcaaggtacacctggacaatggtgttaaaatgaagataatccatatggaatatgtctgctactgccaatgtacgccttatgatctcttccgttttcccggacgcttcctgctgccatgcaatatgcatggatgcatccccgatcagatacagcaaatgctggtacatcgaaatctgtacagcctgcgcagctttatccaggtttccccttaactgatatgcctgtgcctgcatttccgcttcctgtgagaccggcagaatctcttcccccagtatatccagaatctcctccggctgtctctccataagatggcagccacatttcagcattgccgcatttttggcgagatgtacatccttgctctcctcagttatgcgatctagcagttccgtgatatcattcataacctcctgtggtttttccgccaggtgataatgattcattaaaagaattgccatctgcaaaagcagcgggaaacaggaataatactttttgatatatccatcgcactctgccttaacctcctcaaatggatcatttacaaatctgtccgcaagcctgcggtacagcttcttaatatcctccttcaccaattgaggctcatacccaatcagatcatcgacactaagattaaagtatgccgccaaaacaggaagcagcgttatatccggataactcagtcccttttcccatttattcaccgccggagccgataccccaatatacctggcaagctcctcctgcgtcagccccatttccttcctcttactccggatcacatcgtgtattttcatatccgcctcctacaactaaactttcattaatatagtatttcctatttctcctatagcatagcagaacaactacactctcacaacagaccgcttgttaatttctatgaataaagttaaccgtcagttaattttgtttagaagatcacctctgcctaattggagtatggtaaaaaagaggaaaaacagggctgcccctgttttccctcttttttaccatactccagccattccatgcctccaagcacccttatatcgggggacgtcgccacttccaatcacacactcactcctgaaaatcaacttgaatttggaaggtggatttggtttttatgaattgttcgaagtcatcatcgcggtaccgttcctggattgccacgaattcttcctcggatgccgctggatagtaatatactgttatttttgatacgttatggccattaatcggcaacataaatccgcctttgtccggcatatattttccgtctgcgtccagaataaccatctgcagccgttcgtcagttactttatgttcttcgctgaatatgccattgagaatgatttcgtatggtgttttcgagaccgttgcgattcccgaaccatttggcgcgtattggttgatttcttttgtcacggtctggtcactatccttagatacatctacggaaaattcccagggtgtgtccccggacagatggctggcctctttttcaagtgaattgctctgtatatgaattgcgcttactgatagatccagatggaaggtatcgggtattactacttggctcaggtctcccagattaaaatcaattctgaaagcaccggcaaaagtatggtcgtccagatactccccgttcacttgtacggaatcctgcagcccctccggcatgaagtcaaaattctctgccagatccagatactgatagctgattgtcctgtccccggcggtctggtctgcatcatgtttgatttccggaaacggcgtttcggattcgaccagcaccgatatattgattgcttctgtattgcagtatatttctgataaagtcatcttgatcccaccggactcgctgacattgccatcgcggaccggctccgcatccttgctgagttctccagagtatatctgcttatcttccaccctttcaaataaatgtccaatcagtggaatctgttccgccagaaccggattcatggcacaaaagcctatgcctgccgcagccaaaatcactgcagcactgcatcctgtcaggattctccggactttttttctacggcactgtttctgtatctgctccatatttttctctactacagcttttaactcttcttccggcacttcgatgttgttaaatgtgatctgcatacaaataatcctcctttaaatattttttcaactcatcacgtcctctgctcaaataagcctttaccgttcccaccggcacctctatggcgtatgcaatttcatttacagaaaatccgctataatacttcaggattataaccaccctgtatttttccggcaaacggttcacggcattttccaggtcgcacttttcctccaatgatacacccttatcctgttttgatatccggacttcctctatatcactgaagtaaacaatctttttcaactcatcatttgctgtattaattagaattctggttatccatgttttaaaccattccggattcttcagtgttttaatgttctgaaacccctttaatatagtagttcccaccacatcaagagcatcctgctggtttttcatgtagagaaaagccattttatacagatattcctgatattttgttatcagctgcccataggcatcggcatttccccgcaccgcctttttcgcaagctttgagatcctcatctcttcatccatctgttcaccttttcctttccggcaaagaagacttcccgcattcttttttattttacattagttagaccttcaggtgctgaaaaaggttacaaataaatatattcattttcatgctccagaaaggcatgttatgcataaaatatgcatattcacatcggtttaatgcatatttatttgtatttagtgtatatatttaatttttttccgttttctattgcataattataaaatatggtgtatagtatgttttagcttaaacaagggcatcacaaaaattaagtgaacaataatataacaagatacattaggaggcaaatgaaatgagtaaagaaaaagttgtattagcgtattcaggcgggctcgacactaccgcaatcataccttggttaaaagagaattttgattatgaggttatctgctgctgtatcgactgcggtcagggagaagaactggacggactggaagaaagatctaagttatcaggcgcttctaaattatacatagagaacatcatcgatgaattctgtgacgaatatattatgccgtgcgtcaaggcgggcgccgtatacgagaataagtatttacttggaacttccatggctcgtcctgttatcgcaaagaggcttgtcgagattgcgcgcaaggaaggggctaccgctatctgccacggcgcaaccggaaaaggcaacgaccagatccgttttgagcttgggatcaaggcacttgctccggatcttaagatcatcgcaccatggcgtatgacagacgtctggaccatgcagtcccgtgaagatgagatcgaatactgccatcagcatggaattgatcttccgttcgatgcaaaacacagttacagccgtgacaggaatttatggcacatcagccacgaaggactggaactggaagacccggccaacgagcctaactatgacgaccttttagtattgggtgtttccccggaaaaagcaccggatgaaggggaatatgtgacaatgacatttgaggcaggcgtaccgaagagcctgaatggaaaagagatgaaggtgtccgacattattacagagcttaacgttctcggcggaaagcatggtatcggcattgtagatatcgtagagaaccgtgtagtcggcatgaagtcacgcggtgtttatgagactcccggcggaacgatcctgatggaggctcatgaccagctggaggaactcgtactggatcgtgccacctatgaagttaaaaaagacatgggtaacaaatttgcccagatcgtatatgaaggaaaatggtttacccctcttcgcgaagcaatacaggcttttgtggatgtaacgcagcagtatgtaaccggcgaagtaaagtttaaactgtataaaggaaatatcatcaaagcaggcacaacttctccatattcactgtacagcgaatcactggcaagctttacgaccggagaattatacgatcatcacgacgcggaaggattcattaacctgttcggactgccgcttaaagtacgcgctatgaagatgcaggagcagaaactgtaaaaagaagcattctacgaggcttatcatacatgtaaggaaaagaagttctgatcaggcggcaccccgcataacagaacttctttttctatatgtcatttatcattttctagcgtactgttaaaataaaatattagacatattgcagcaatgaattttcaggctaggcttcctctctgtcgtttgtcagtttcagcttgtccaggataaagaacatcagccccatcagcatacccacgacgcaggcaagaaccattcctgacagctggatgcttccaaactgaacggatataccggaaagtcctgttacgaaaattacggatgtcattgccatatttctggattttccgtaatctacttgtgcctctaccagaatacggataccggacgcgccgatcatgccatacagcaggaaagaaatccctccgatcaccggacctggaatggtactgatcagtgtggtcattttcccaatgaaggaacacacgatggagagcactgccgctcctcctatgacatagacactgtatactttggtgattgccataacgccgatattttccccgtatgttgtggtgggcacggaaccgataaagcccgaaatcattgttgaaaagttatccgcaaaaagagagcggtgaagtccgggatcctttaagagatcccggcccacaaccttactcgttacaatctgatgcccgatatgctccgatgcgatgaccagaagcacgggcagaataatcacgattgcctcccatttgaattttggggctgcgaaattagggatggccagccaggttgcggcgccgacctcggtaaagtccacgatgccacagagcagagcggccacatagcccacaatgattgcaaccagaatcggtataacagacagaaattttctaaataccacagatccgatcacggccgtcagcagagtcgccaggaatacgataacatttttgggattaatgacctcatcctgcagtcctgcgtttgaggccgccgttcctgccagctccagtccgatcagggccacaacagggcccatagctgccgggggcagcacaacgtcgatccagtccgaaccgaatttataaataatcagagccaggatacagccaaagaagcccacgaccacaaagccgcccagcgcataattatagccccatttgctgataacaattcccgccggtgccaggaatgcaaagctggagccaagataagccggtgctttcccctttgtaattaagataaataacagtgttccgataccgttcataaatagtactattgccggattgattccaaatataaatggaaccagaacagatgccccgaacatcgcaaacatatgctgaatgctcaggggcaccagcatcttaaacggtactttttcttctacctgaatgattttcttactttccatatagccctccatttctctcttgttcctttaaagtttttcatcttttctattgtaccacagaattctgtatacaaaaacaacaaattgagagttagttaacgagctttagactcattgacggatggcggacgcgaatgacgaggtgagtccgggctccaccttaggaacgagtctttgcctaccggtcggatgaaccagccaagcggactgtaagcggcaagccctccgacctgtatggtcggtttaaaacgccttagagcttcttcgttaagcggtcaggattttaaaccgaccatacaggccggagggcttgccgcttacagttcgcttggcgtcccccatccgcgccgagactaaagctcgtcgctaaatcccgatttgctttataaacctcatcatcattgtcgcgcaagccgcccgatctgcagatgccgtcggagccagtgttccatctccattaccagtcataataccttctgcgttggcccactgcattgcttcttccgcaaaggggcttacagaataggcgtctgggaaatgagaaagactgtttttgttggacgtatcagcgccgaggtattgtacataacggtaaagcaggacggccatttgttcacgggtaatgaaatctccggggccgaatgttccgttttcgtatcctgtgataattccacggtctgcagcccatgttactgattctgagtaaaactggccgtctttcacatccggaaatctggctgcaaacggtgttttattttctcctgatgcccgatacaaaattgtagcaaactgtgccctgcttactttctcggacgcaccgaagactgtaggctcaaggcctgtcattattttatttttgtacatatagacggctgcatcgtaaaaccagtcgtttttctttatatcgttgtaagggagcgtaacttcctcttcacccccataaaatgatgctgccctttccactgccttctgcgcatttacaatgccagcccctgtataaatatcatagcctggcgttcctatatctgtggctgtaacttgtagtattgttcttacttcttctaccgaaagctcaggatttagagaacacatcatagcggcaactcccgccacttccggagctgccatggatgttccgttcatatttccataactgccgcccttaagtgtgctccagatttttactccaggcgctgatatgtctttcagggaaccatagcaggaactacttgctttttgcatattgttgtcaacagcaattacgctgattgtgctgtcataatccgaaggaatcacgttgatactcccgttatctccagtaccataattacctgcggcacatatgatgatgattccttcatccgcaagactgcggcacatcctgctaagcagatcatcatacaaaccgatttctgactttctcatacccaggctcagatttatcaccttggcccctgcatttctggcatattccaatccctttagaacatatgacacactcgttttctgatcctgagaaaatacatctactaccatcagatccacaacggaattgtcaagagcacttccgacaccggctattccctcgccgttgttggcctgtgccgcaataatcccactgacatgagtcccatgccctcctccggaagaatagacaccattctgatatccatctccctgaagaggtcccatggatccgtttgaattcaatatctctctgctgttgtcaagatccagcacgctttttaagtccggatgaacaatatcagctcccgtatccaggactgcgacctttactttgctgtgttctttttgattaacgatctcccaggcctgaggcactctgatctgctgcagataagcctgccgcccgaaataactgtcgtttaccggcgtgtcgttgaaaagctccagttcataatttggcgataccgcaacaacacggtcatcggcagcatatacctccatggcctcttccacagatgaatcttctgcaacagaaactaccccaatgtttccctctgcagtctcggatattaactcaatcccttcatccccttgttcctcagccataacctcggcctgatcctctgagacatcctccctatacaagacgagcacttcacccggcacataggaagcgctaccggttctactgccttctgtatctgtcccgtaaacggtaattacactgctcaggatcagaatggttgtcataaatactagacttaaatctcttattgccttcctacattttgacatagacttcccactgctttctcaattctattcattatttacaatccggaatatctctgaataatggttgcgcatacggccctgctgacctgtccctgcggattcagctggccgttcgtcccttcaccctgaataattccttcgctcacaatccactgcatggcttccgctgcaaatccacttacattttttccgtcgctgaatcttcccatatctgcccttccgtctgtatccttccccttatattgtgcgtaacgatatatcagtgttgcgagctgttctctggtaatattatcgcctgtaccaaataaattatcgtgtccataacctgtaataattccaatactgtttgcccagctgaccgggattgagaaaaaatgatgatccggtacatcgataaatttattgacatatccctgctgagggctgccctccatgcgatagaggatggtcgcgaactgtcctcttccaagattttctcctgcaccaaaattagtttcatttaatccagtcatccatccggcatcgttaactgcttttactgcatctagataccagctgtcataagatacgtccctgtaccccattccgtgcatatcaaacccttttacaatatccttccagctctgtattccaattgtattcaaacactggtttgttgccccgccataaatattcgtatccatatacttaaagacctgatatgcctttcttcccagaatgcccagctgaaggcccatttcatctggattgtcctcccagcttctgaaaataactgcatcgaccatgtcattaaattgtccggcataaaaagtatatgccagactggccgcctgatagtcttctccgcccttagcatcaaacccctgctcagacaagataatcctatgctgtgcaccgtaagtattcttcacgtaatccgtcagtacatttagattagccgcggtaacaaattgtgcgttcagattattcggtgtgtatttattatttccccataacagtttctcagactctgtaaacttattacttgtcggatccatcacaaccgcatagggatgaaatgcaacacaccagttcacatctggctgcaatacgttcaattctgcagcaaatctgtcaagaaaatcttttgcccctatacctgtataatttccattattattccagcttctgtccagcgaaatgtatgccttcgcatctgccacaccttgacgctgtacattctgttcctgcagtgcgttataaagcaaaataaaagactgcgcatatacctttgcattggtagacgggcttagagtaccggtccaattataagcggaaggcatatttacttcatttcccaatatccagttttcaataaaacagccgggctgtccgaacttttcggccagaaaaccaaaaagcgcactccatgtgtccctcgcttcctcggtctttgtactcaatgcataaaaattgtggccccgctccgagttatagaccaagtcttcccattctttcagacctctgtcatcctgtaccagaagtacagtcgttacagtaaccccttttgcattcagggcgcgtactgtcttctcaaatcctttcgaataattagaattaaacatgtaagtttttccattgtatgtatactccgtatcaccattcgagagaaactgagtgatgcccaggttcagcagcacatgtttaacaccaaccatcccttttgctccggctgacatccattctgacccatgaatcccttttttagacccctccatctgaataaccgcactgctcccactgtaagcctccatatcgggtatatcaggcacttctgcctcactatcaataaccgtagaaggatccaatcccagatagggcttctcaatcatcggctcttctgctcccgcctctgatacgcccatccccatcaacagcacgagtgccagaaatcccgcgactattctttttgctttcttcatttaagcctccccttatttatgccctgcaaaaatgaggcgcaatgccgccttccagcgtatcgctgcctcatcttaaatcatgtctgtttcatattctgatacttaaatgtctttctactgctctaatgcgaaagcctctgcctggctgtcaaatgtaccaattgcgctcatcataaatctgctgatgattgcggaacactctgctcttccagcagttccctggggattcagagttccatcaccatttccgctgatcagtccgcttcctaccgcccacttcatagcatcaacagcaaatccgctcacgtcttttccatccggaaatacacttaaatcccccacacctgaaacgtccagtttagcaaattgggcatatctatacatcataactgcaatctgctccctggtaatctcatcgcctgctccaaattttccgtccgcatatcctgtaataatgttaacatctttatcgcttgcccacatcacgggttttgtaaagaattctccatccggaacatcaggaaatctatttgcatcatatacagcttccggcatgtcttccattctccagagtatggtagcgaactgcgcacggctcaccttttcccctcccccgaaggtcgtttcattcataccggtcatgatatccattttatacagcattgttgcataatttacaaaccagtcctgacgtgtcacgtccgtatatggcaggtcaccatataatgccatctctatcaactcatagctgccgtcctccctgaggctgattgccataacagccatgcagctttccttatcccacgtagatggaagggttccggagaacttcagcttaagttcacctttagatgccattttttcagcgtttgcggcaaccgatgcgtcgttaggattaacgatgattgcattgtctgcagtccactgaaagctgctcacgtcatcctttgggtcaagtgaaaagatacccagtgcgagatgccctgtttcataagtaatatcagaagttccattttcaacttttaagtcaaatgtgacctgcttgtcagccgccacttcaccttccgttgagattgacatgcccactcttccggcagccttggaattgaatcccgcaatcagggttccaaacatcaccagggcaaatgtcagaaggacatttttcatcgttttttcatagttactttcatacatttcctccttgttccttgtgtcttacagtccatacttctgcatgaaccgcgtaataatagttgcacaatgtgcacggctggcatttccctgtggatttaaggtcccctgatctccctggatcagtcccgcgcccacagcccacctcatggcttcctgggagaatccgctgactttgcctgcatccggaaaactgttaagatcagcgctgtcctttgtatctagtccacagtattttgcgtaccggtacatcagcaccgccatttgctctcttgtaatgagatctccggggccgaatgttccattctcataaccggttatgacctgattgccgtaggcccacaacaccggagatgtaaagaaataaccgtcctgcacatccgggaatacattgctgtatgatacagaaggagaaccggccatacggtagagaattgttgcaaactgcgcgcggcttaaatcttctcccggtccaaacctgaacatatccataccggtcatgatgccacggtcgtatacaaacttcacatactcataaaaccatgcacttccatccacatccataaacctgtcaacacctgccaggtttgtccccttattaacaataacgatactatcagctgcaacgtaaccatacatgctgctgaaatcgaatttgcctgaagaagcgtctagtcccgttcgggaactgttcagcacaccatcgcttatcactttgtaaaaaccgttttgtgatgtattatctaaaatcagcagtgatgtgttggactgagtacctgttgagtaaagaaccgtagaacctgcattgctctcggctcttacctgtacattctgatggctgttcgccatggtatctttgattgcaattgtatatacattctgatcctgatttccacccgcttcatccaggaaccaggccgcggctgcagccttttctccccagtacggatcagaagcatacttcacattaattccgctggccttattccctaaaaagccgccgaaataacgccagtccttgggatttaaatacccttttgacatataagtttcagaaaatgctttgatacaaacatctatacttgcgtaagaaaatgcatcatccggattagaatccactgcatttattccaaaaatattattctttgtaagtgccagattactgtttccccatgcactttcatttgccgcaattcctgccgtcagcaggccgttcactccatatgtattctgatggcttaccaaggaagatcctattccacgcatcttagactcggttctggtctcacttgcaattagggaatccatagacgccgaagaataagaactggagcttctcataggcagatattgaaagtagttataatatgggctgcccggattaatggaactgctcctgctgttgtttttataatcattcagcattaccgcaaatttatctgaagcataaaaataatggccatcataactataatatgtactgccctccgccaggaaagacggggcgcgtccacagcgaatactgcctgcataattactgctattcaaatttgttgtaattctatgtacaagccatccgcctgatacagtgtagtaactcaacgactttgccgatgatttattcaacacttgtacttcgcttttgtttacttctcctatcacgcctgaaagcataaactttactttcccgcccgattctcccaggtatgcggcatctgcgcccgaagctccattggtataacctgcatcgcctgtaccaacttcggtatattctgtcaccgcattccctttggtattgaaattcacaatcttctcactgctgttggcaaatgttgtgatttcctcctccaccagccctacctcaggctctatctcatagatgtttccctcttcatccatgcctgttatgggtcggccttcgtactcctctgcctgtacgtcaaatgagccccacatacctgcaaataagcagatacacaggctcagaatacacagcagtgtcttcctctgctttctcatttacgtatactcctctctgtcttttgtcacactgcagctacaggttaaaacctgtcccccctacagtccatgccatcagtataacgtatcttcacctcatacgcaagaccaaaatgcatacatgaatcccccataatttaccatatattcagattattcatcacatttactgattaatcacgactccatccaggcaattatctgctgactgttccggcgccgtttcctggggcaccggatcctcagcaggtgcctgcggtgtctcttctgcataagaatagtctgtataatcgtctgtattctcctgtgcaccgctctgcacatcagctgcctgagccgctgcctgtgcatcggctgctgcttttgcttccgcttctgccgctgcctgggcctggacttccttctgtgctttcacgccaagttcctgttcttttgtactcacttcatctccggatgccttgcttgcatattttgcaaatacaacatcatcttcaaagcagatttctacatccttcaaaatatcgtcaaagccaagcgaactcaactccagcttactgtcatccgccatagtcagctgtacattgtaaaccacattaatggctttgtccgtggctgccgcatttgcatccgccgtcttctcgggcgtgtaataaagctgtgccgtctcaccatttttcaaaacttgatctgatttcatcatatttgccggatattctgttttatccgatgtcttaatggaaatccctgtcacatctttcccggtactgtttttcataagcacttcataggacgtatctgtcttcgtgccgatcaccttatattcttccttctcctctttgtcgtctgtttttgtttctgtgctctgctttttatcctctttctctgtaacctcattttttttgctgcatccggcagctgctgcacacagacaaactgccatcaacagacagatcactgctttcttcatcttgtttcctcctaatgtcctttttcttagttccattgtatatctttgccggccacaataaaagactggcctttatttgtaacaattgtattaatatggagttgcccggcatgtacagagcttccctttatgtatagctgatacccgtttccgtctccctcttctgtctttgtataaaatgttttataggttctggattccattgtctgattatttcttacagatactgtaatttctgtgtccccggatatatacttttcatctatgctaccctttatcagcagatacgaaccttcttttgaagtctctattgtggagtccgtcacagcttccggggcaaatattgcttctacctgggacgtttccataattggaacatcctcgataaagtctttgatattacgttcaaccttttcaatcacgacataatccggatgcagatcttctatctgtgtcagattatagggaaccagtcttgaaaaatacccctttcccatctcatctgctacaaaaggaagaagactctctccaaaggaatcccgaaacataagtatgcttccctgtttatcagggttcaccgtttctatccattcgtccatattatcggtcacgtcattcacataactgaaactttgctgtttgtcatagaaatattcttcttccggttcggcagccagcggatacagcatttcatcgatatcccccgtatgcaccttttggatctcataagggacgttcagataggtctcgtgttcccgccctatagaatccatcagcgtgttatatgccagtaccgcgccccggttgttccagtgggagtctctttcaaaatacaatacctcatcccgggatctaaaagcatcaaataaatttgtatattgaattcctgcagccagaagcctggagctgagcatggcaatattattcgcccccccctttccgataataataaggcatgtttccactgtagaggctgtttttattgggcgctatggtcaagcggaatgtactgccctgtccctccacatattcctggatcagtgacagattgtggacaatattaaacaattccctatccgacagcagatttctgccttgatagtcgtccagtgtgccactgtaatacagccatccatccgtcccaagaaccacctgctccgtcgcctggctcttaaccgttctgcttcgtattactgcatttgcagtaacaaaatactgcctgaaagcaaagtgatcctcaaaatattcgcccatttcagataaatagtccttattccatccatcttcattttttatcgccggccattctgccagaaccgtattctcagaggtagtatttgtcggccaaaatgtcatcccggcaaagggaactataaggacaatccagaccagtatgataaatatcagatatctcttatttttcatcttctgtattctcctaaaatctaaaataaataaaaggattatatgtgccgctggaaaggctcagcatacaaagcagcagcaagataaaacttcccgcatagcttgcggcagttgctgccctgcccttgccgcctgctttttccgacagcatcctgaacttatccaaaagcggtatacttccaaccactcccagaacaactgtcaagtcaaacagcggattcatctggctgaccgccacgtttatcatcccggcactaaagtcccagcccgtaaacattttcccgatcatttgaattccctgggtaatggtatccgcccggaacatgacaaatcccatacagacaactaaaagagtgtacagatggcagaatactttcggtagttttttaataggaagaatctcttccagaagaagaaatgccccatgccaaagcccccatagcacgaaggtccagttcgcaccatgccacaggcccgtggcaaaaaaaacaataatcttattaaggcaggtccgcagttttcctttccgattccctcccaaaggaaaatacagatattctttgaaccaggtagacagagatatatgccatctccgccaaaactcctgtacgctcccagacacatacggatgccggaaattctccaggaaatgaaatccaaacatatgcccaagcccgattgccatatcgctgtagccgctgaaatcataataaatctggagcatataggcaatagcggcaatccaggcggagaaaatattaatttcccctatcggagtcccaaacagagcgtctgcagccactgccacagtatttgagatcagaacctttttggctaatcctatgataaagcggcgcatcccttctgcaatctctttcagatcggcatgcctgtccgtaatctgcttttctatatcatggtatttaacgataggcccagcgataagctgtggaaaaaatgagatgtataaaatcatattccacagatttttctgtaccttaacatcctgccggtaagcgtcaattacatacgacattgcctggaaggtaaaaaatgaaataccgataggcagcgccaggcggacttccggtatcgccataccacactgccggttgaccgtacctatcatcatatccgcatatttaaaaaccaccagaaatcccagatttacacagatcgataatgccagcatccctttttttaaacttctgtttgctgctgccatcgtcctgccaaacagataattgatgataatactgaaaatcatcagcagtacatagaccggttccccgtaagcatagaacagcagactggcaatgattaacaaaaaattctttaaacgcagagtcggcagcaaatagtacagcactagaactaccggcagaaatacacacataaaaaccattgagctgaacaccatagatgtttaattcctttctaccaccgatactgcaataccgggctgttgattggctgcatatagaaattatatatgccaatctctgcctgagcttccggatcgcatatgtaagatgcgccatctatattgatcacgacccagccatgaggcccataacctccggatgccataccgacctgcccctctacgaattcagcgtcataacccagccctttagccaggaaataaaaggcggctgcataacagtagcaatttcctcggtgttgttcaaaagcccagatagagtaccattgggcccttgtaaaaccctccggcggatccagcggaatcggcagcgtataataacttacattattcacgacccaccagtagcaggcattcagatcctttccgacctcgctgtaaacattctctacatgtctgtccacgcgcatcttagccgctgagccttcgattttagcgctctgttcccctgccttcagacggattcccatctccagctcgacatatacaagtaatttataggtaccaacatgatagccatggttctttacatcccctgtaaaagcataagttccgtttgactgccgtgttgcagtataccaatataaatcactctggtcatcggaacaccatgccggaacctgcactctgcggatggcctgagatgctgtcacatccgatactgtaaccttaaatgtcccgtcctttttactagaattgctgacagttactttcccgacgcctgcactgatttcaatgtccggaagctgccccggcagaaacgtctcgcagaatctctggataatcgttgcacaaaccgccctgctcgtgtttccctgcggattaaggctgccctggtctcccttgattataccgctgcccacagcccactgcatgctctcttttgcaaaactgctgaccttagccacatccgggaaggaattcagggattttcctttttccagctgacagcccttatactgtgcatagcggtacatcatcgtaaccagctgctctcttgtgatcatatcagaagaaccaaatcttccatcctcatagccactgatgactgccacctcatccctgcttgcccataaaactgctttcgtgaaaaaagttccatccggtacatccggaaaacgaccggaataggaaacatcctcccttccatcaatccgatacagtacagtcgcaaactgtgctctgctcagttcagaggacggcgagaacatattatctcccattccggtcataatacctttattcaatacataggacacataagaatagaaccagtcactttttctgacatcactgaacacttctgccccaatgctgtatgtactgatatatggttctgcctctgcctgggcctcagtgtcctcttcctccccatcctggagatctgcttcttcagtcccctcttcctcctgaagatctgcttcttcagtgtcctcttttatctcatcagtttcggaaatgcctgttatggcatcctcctcttttccgggctgtccttctgctgtctggctgtctttatcagacagttcatcagtttcacctgtgggctggcccggttcaattttctctgctgcttcgttgccccggacatcatcaggctcctgggtgccttccgtcaccacagcctggccaactgcatattcatggcccgttatatcatcctgagccagcgcagttcccccgaacagagaggttgtcataaccagtgtaagcaacaaagcagtagtttttttagtaagcttcattccatctcctcctattccttatatatcttacacattttccaataaacggtcaagcctggcacacaatttccctcctactaattattacattatttatgcaaaattttccctgctgcgcgcagaggagcagttaccttccagcttgttgattccgcatagtctttgatctcttttctctgccgcttgatctcagcccgcagtctgtcattttctgcctgaatccgggaacactcttctgatttacggtgcattctctcattccacattctatcacagaaaagatgaccgcccgtcatttgataaaaatctttgaccgtaaactgatatttttcttcaagcagccgcactgcatcctgattccgtaataattcatggaaacgtcttattcctgctgccggaacagcctgttctgaaagtataggacgacagagcagaaaagccttttcacactccagttccagatctgtctctgaatccgggcaaacaaagtcattgcggaatgtatcgcaaaacagcccatcgtccatcccatcaaagaaatgggcacggatatccatatattcgttaaaaaatcttgtattgctgatgtccgattgattactgttatttatattctcctttccttcccccataaacctgcgcatggcaaggagcctctcgggcatcacataaagcggatgctttttagcaatacgaacccaataatcaaaatcatgagactgcatatatcccaggtcgaaatctcctgtttccctcataatcccagtccgcataagcacagaaggatgtgacaggcagtttcccagaaaataaaaggtgtggagacagtcgctctgccccctgaaacttgtttcaaacaattccaccatttccctgtactcttcattaatatttcgtcccgtttcatcaattaaatcaatccatgaaaaacagatgtccctgtccggattggagcgaagaaaatccatctgccgttccagcttatccggataccagatatcatcgctgtctatcctcgcaagaaattctccctttactttttgaaacccatagttcgtagcgtaacagatatgccggtttttctccagcttgtataactcaatccgctcatccttgtagctcttaatcactttgcaggaactgtctgtggaaccgtcatccacaataatgaactgcatgttctgatagtcctgtctcaaaacactctcaattgtttcccctatcgtatcctcatggttatagttaaccatcagtacactaactaactcatttcccattccgttctctccatataacttttgtatatttacttcctgtttcatccccttaaaatgtggtccagtgccccaaactgtccggctgcctctgcaattagattctccttctcaggaggtttcagcttgtccactttccctatcagctcctctacatccgaattcaggttgtctagctgcagataaaacgggtagtcattatcctccagagtatactttgttttcagatcataaataattggaagaaccttttttcccataagccatcccagtataatactgtgaaatctcgtcccaattacaatttcggattccgaaaaacaccctatgcattcctggagattctgatcataacagcattccgtaacccggtctttatcaggatttcccattaactcccgaatttcctttatggcctcttcatctccctgaaatctgcagaatgatatgaacttaacttcataccctctttctaagtatccgtctgcaagtctggcaataaatcttttataagccatatcgtactggctgatcccccattttccatgccggttcttcatatcaataacagaaaaaagaacctgatgcttctgcttttgcacagctgcagcatgatagttaaaaacaacatcaggcgcatatctaacctgcggaagttcaggaaacaggccggcggaatatctgtccctgaagctgattcctttatactttataaacagttctctgtaactttccagataccgctcatcttcataagggccaaaatttgctccaactacaaagattcttttgctcctggcacaaagctctgcatccagacggtatgcgtctgcaaaatcattctgatgctgtacaaaaacagatcccccgatatggaccgtcgcataagatgttttcagcatccacttccaaaatcccctgtcagtatgcttgactccgccggcaatgcggtccattacacgaacataccggtcttctggtgagtataccgacaaattgcagatatctttaaaacgctctttgtaagtgtgatccgcaaatattctaaattgaactctcggataacgctcacacaatatccggatcaagagatcgtctcccaggttccccgccgcataggcatggataaatacttttttcataaatttttgtctccattttcaagtcttatcatattccgtaaacccggcctactgatttttaattataacatttactattctttcaggcaatctctcctcgacaaaattaccaggcgtgttgcattttttttactgctcctttataatcttcccataatgataaaagtaatagaaggagttttaaaaaatgactactgtgcctaaaaacaaacgaacaacattttttatcatgagcctcatcatgcttgccggaatttgtgccacagtctttgcagtttcattaaaaaagggcatgcatgtagatgagtattacagctatgggctcagtaattattccggagatgacatctttatgcatatagatttagggaagacctacgatgaccctgcaaagccatttctggactatatggctgtacagccgggcaatggtttttcatacgggaatgtatgggaaaaacagagcgccgatgtacaccccccactttattacgtaatccttcatactgtatgcagcttttttccggcaaaattcagcatatggtttgcgggtgtcatcaatattgcttttttcagcggcattatattcctgacttaccttacgatgagacgcctggccatgcagcgcacttcggctatgactgccgcattattctgtgcattggcaggcggcctactgcaaatcaatacttttctgcgtatgtatacgatgctaatgttttatactacgcttttgacctggcttcatgtgaagtattatgaagatcagccattacgtttttttatttattatcccctggccatactctccggcatgctgacacattattacttttttatcttcctttttttgcagggaatgtattttggcatttcgctactcgttcgaagacactggaaatccgcattgctttatcttgcggagactctgactgctacggctgccgcagttttcatcttcccggctatgatcacacatatcttcaccggttaccgggggaaagaatcactggataatctggcgtcttccttcggttatattgacagcctcagagacttcttacaaattataaacaacaatctgaccgggaatatactctatattatcctctttctttttgctgccgcgctcgtctgccggttacatataaataagagggcagctatcacaaacagatgcctttggggtatgcttttgtttcctgcggtctgttattttctactggtttcaaagattgccgtttaccattatgatagatatatctctccaatatatcctgtcttaatactattaataagcggattgattgattttacagtccgtacattcttcagagataagaacctccgctttactatttcggttcttttgaccatggggtgtatattcctcagctattggggatgcgactggacttattttgaaaaacaaacagagctgtctgttgagactgcaaaaaaatatgccgggctggattgtattattgtcaatgacggggtgaatttctggaaccataccctttattatgaagctataaactataattcgctaacatttttatcttctgaaaacttagatgtttatacggatacgacggtttatcaggataaacccgtgattgtttacatcatggatatcctggaaaaccaagaggaactgctccagaaactgctgaaacaaaatccatcttattccggttatacccatatcacagacagtcattatgcgaatgggtatctgctggaataaccatttccccggtgtttgtatttcgggggaccccttgtgtataattttacaaggcatcccgtatcaccctaagcgcattcccggacatgattttatccagctgacgctcagtaatgcctctctttttcatggcatcccacaccaggcccatctcgcacacatgcccgatccacccgtcacgtaccttattttcaaaaccgtcaaaatccgttcctatagcagccacgtcttcaccgccgcagcgtatcatatacactgcatggcgggcaatatcatctaatacggcctcatctcttccggtcaaaaacgccggataaaagttcagccctgccacaccgccgttttccgcaagcgcgcggatcatatgatccgaaagattcctgggatggccgcagagagctctggcattggaatgggaggcacagaccggtgttttgctgattcttatacagtcccagaatccaccgtctgatagatgagacacatctacaagcattccaagttcgttcatccgttccacagtaaggcgtccaaactctgtaagccccttctccattatacttttgtcacgggaattcggatacccgaggcagttcggatggttccacgtcagcgtaatcagccggacacccttattgtaaagctcatcaatcctcgatagactgcctttaataactccgccttcttcgaccgtttttacggcagatatcactccattcacggaatttgttgttatttcctccgcagaatgtgcaacctgtattttctcattctgctcctgctctaacctgtctgccatggccagtaccgccaaatatgcgcgctcccatgcttccgatgaaatcggctccgtccctcttgtatgtacattcttattttcaaaggatactgcatttacaaagcatgcaaaaaactgggctagtgtccccgcactttccatccctcccacgtcaatactaaattgattcacagccaggcactctcctttgggggcatccatcagcctgctgatcgtatcacaatgcatatctattaatcccatcattcaccattcccttcacacttataatgttttcacatattcatggcaaagtatatccaagggcacaccgtaactcaggccctgcgggcggacgtgcagtaaaactgcacgacaaggtatattttaccacttttttacatactctataaccactacttttggcgggcgtaatcctgtctgaattatcctatgttgaaaaaggagtgcttatgaaaccgaaaatcggaatcgttgtctgcggcctcatggacgacaggcagttcgtgactaatacttatatccagtctgtcagatactccggcgggctgccctttatcctgcctctgatcaggtctgaccacgcaatccaggaatatattgccttctgcgatggatttctcttttgcgggggaaatgatattacgcctcttttatttggagaagagcccaaaaatgggatcggaaaaaccgatattacgctggatctatttcagatccggctcatgaaggctgttctgaccacaaagaaacctgtcttttctatctgccgggggatgcaggtatacaatgttgcctgcggcggtacgatctatcaggatatctccctgcagcccggccggccgctcaaccatatgcagcagtcctactctcgcgcagaagtcagccacaaaatccaggttgaaaaagggacacagctcaggaaatacatcggctcccgcctggatgtcaacagtttccaccatcagacagttggcatgctgggcaaaaatttgaccgcatgtgcacatgcatcggacaaaaccattgaagccatcgaaatgcctacgcatccatttgcaattggcgtgcaatggcatccggagtgtatgtaccgcacgtctcctgaaatgcgcgaactgttttcagaatttattctgcatgcaaggctcaggcctccggcaccgatagaacagcagtccctggaaaaataataccatttatgtcatattttagtctatctctaaaaagactttgtttttttaatgctgtttattggaaatttttttacagcagctttattgtcaatatataccgtaataaccggccaagtataatttttcatgccgcggacataataatcttcgaaaatattatttctcaaaggaggtcagattatgtccgaaatttctgtattagatctgcaaaacttacgtcacctgattggcggctatgacacaacacactgcaaaatgactgattatgcatcacaggctgaagaccctgaggttaaaaaacttttccaggatgcagctgattctgcaatgaaaaacaaacaggaactgatgaaattcttataagaggtgacgaatatgaatgaaaaaacaatggtatccgatgccttagtcggagtaaacggagaactgaaaatgtttggcgacatgattccacagactgaaaacaaggaattaaaacaatgcctgaaacagatccgcaacgaatgtgagatgtctcaggagaaactctatcaggtagcaagagaaaaaagttactatgtaccggctcagaaagcatcacagcaggaagtagaacacgtaaaatcaatcttaacacagcctaagactttttaagcggcgggacgtgggcgctgagtgagagataggcaggggaacatttgggtaatattcacggggccgtgcaccttgctgcactgcatccgggccagcaaagcgatgggggcgggcatctggctcctcgccacaggcgactttaaatgagccagataccgttactatgtacggcccatagaccgtgcatagtaacacatttgggactgtctatgctttttcaactcctgtccgtttgcggagaatccgttaaagaaaaaaagggagcatgaaggaattgccttcatgctccctttttttctttaacggattctaacagcgctctcgatggagttcgaaaaggtatagacagtcccaaatattcccctgcctgtctcccactcagctgagtgcatccggttgggagtagcccctgtacggggctttttagcatacggggaaggcggattgggactggctatgcaggatttttttgctgtgggttgttgctgctacgatagctcctaaaataaaaggcagtatatacgttgcgaagcggtagatcagcattgcggatgcggattgtgtttttcctattagcggggtgaacaggaggacgaagaggaattctgcggctcctactcctccgggggcggggatgacacctgacagggcggtcatcattgcggccgtggccatgtatagtgagagttctgaggaattgagcaggtggaagatggtgacggggatgagataccatgcgcttagttttaggaaattcagaatgaacaggtctaataatagcttcttgttttttaggaggctgcgggcctctgtacgcacgatgattgcttttttctgccatttggacagatcttctttttgtttttctttgcggatgaccttttctgcaagttggaatattaggcggtgcagcggggcacagacgcaggctgtaatcagggcggcagcaactaatacggcaagtaccacacctgtcgccatataggttttatattcaccgaaatattgattcattgctccatagttacttagaaaactaaaaagaaagtatagacaaatggagatgcgctggatcgtgtagtttatggtgaagattcccaggcttctggaggccggtatgcctcttctgctgacatagtacatgcccgcaggggccgttccgctcccgaacgtaaccactctgaaaaaactgtaatagaaggaacagccgatccccacgctccagggagtattctcgtcacaggtgcgcagcagttttgtcagtgcacagccatcgcagcaattgtacaaaatgctgagaaaaaacacgcctgtgaccaccttaaaagatgttgtttttaactcgttccatatgctcccccaggaatccttcagggccaggaatgcggtcaggaaaactgccgccaggaaaagcagctttccgatgcgtttccatgaagaacgtgtctgctctttctttttattttcctgcttcaataatatccaccttatttctcccacagctcatccgctttttctttccactccttcgcgtacatctcacattttctgcagagatgctctaccgtctccggggactgcatgtcagtggatctggcaccggttttattcaccatttccaacagtttctccgggttttcaagcatcggacatgggcggagatggttttcgttgaatggctgcccctctctgtatgccatgaaaagcggctgttgaagcgcttctaagaggctcacctctttgatatttgcgctggaataatggataaatacgcatggctccacatctccgtttggattaatatggcagtaattccgtcctcctgcgatgcatccccctacgtattcgccgtcattttggaagtcgaatgcaaagatcggctttcctccctctacggccctgatttcacgaattctgtgatatatgtactcccgctgttcctttgtcggcaaaagctccactgccgcgtcattaccaaccggcatataatgaaaataccatgcgtaccggcaccccttttcaataatcatgtccagaaattcatcggatgttacggtctcaatgtttgcccttgtatagcagatcgaggttccgaatatctggccgtgcgcctttagtttatccattgcttccataacctggttaaatacaccgatgcctctgcgtccatcatttacctcctcatagccttccaggctgattgacagggacagattcccgacccggtccatctcttcgcaaaacgcctcgtccaccagtgtgccatttgtaaatgcatgaaatgcacagtcattatgtttttcgcagagcctgatgatatctgccttcctcacaagaggttccccgccggtatacatataaaaatagattccgagttcttttccctgggtaatgatactgtccaaatcctcgtaagtcaaggacagcgtatgcccatattctgctgcccagcagcctgtacatttcagattgcatgcactggttggatccagcaggatcagccatggaatgttgcactgatatttttccctgctttcatgcatgattttcgttccgctcagcatggcttcgaatcccaggttcatggccgttgttcggatcacattcgggctcacttcatctaaaatccggttcacataagtcatccattttccatccttgtcccggatgatcctccttgccgcatcataactttccggtaggaaccggtcttttgcaaagctttccgtcagatcaaccattttcagaaaacttttctctctgtctttattgatgtgcttcattgcggaatcaatcaccttgccaaatgccgcccgctctgcctgatgtctcaattttcccatttcccatttcctcctttttttctcgtttgtcacttatcatttcttcattttattccccttatcagcaattcaattccaccaattaacagaatgcatccgcccagggccactattttgtttttcgactggcaccccatccaatatcctgcataaataccgagaatcacactggcggctgtcacaattccgatgatgaagactgtatccgtcaggtttgttctgaaaagcccaaatcctattcctgccagaaatgcatcaacgctcgttatacatgcccacaccgaaacctgtttcagctctacgccttcctccttgtgttcgatgatcgtctgatgtcttttgcccttaaggatcatatacatgccaaggcacgcaaagataagaactgaaatgtatttccagtgggctgcggccttctctgccgatgctttcagaagcggaatattcgtgatcatatttccaagcagaaggctcgccatctgccatacggtaaaaacacagcttattttaactaatgcagatttacgaatctcaggcatcatcgcgcctttgtaaagtgcatatgcaaatacatccagggataatccgattgaaatcatcaggatttcaaaaagtaccaatatcctcctctccttccctttcgtctgcttacctttattttatcaatggttctgaaatttcataagatgcagacttcacttaatgtatttttattagaacaatttttcggaaatgttccttataagctacatattttctaatttgtagcccgccgcttcattttctaacggtgaatatgttataatatcagtaaaggagtggagttttatggaagataaaaaggaattaacaaaggatttactgacctcatcattcaaagaactcatcatgcaggtgccttttgaaaagatcacaattaaaatgataacagacggcgcgggggtcatccgcccgacattttataaacattttcaggataaatacgaactgcttgagtggatttttgaaaagaatataaaagaaaatatacaggtgctgatcgagaataatatggaagaagatatgttccggcttctatgcagctgcctcgaaaaggaaagggccttttataaaaagctgtacgctatacaaggccccaattcctttgaggaactgatgtatcaatacgtatttactatatttctggacttactgaacagatatccgctgaaatctcccgacaagctggccgctctttctaaagatgccgttgcgagattctatgcttttggcctgactgattccttgaggtactggatcctgcatgataccgagtacacttctgaacagctcaatgaggcctaccattacattatccgctgttccatcctggatctgctcgaatatccggtaccataaccccctgtcccaatcaaaaccgggcatggttcttgattctaacggacagttcccgggcgcagtaccggaacctgcctgcgtataattctttcataacagccttttccaacagatccagcagatatgagacctgtctctctatagtctccgccggcatatcctgaaagtaaccctccgtttcactctgcccctccccgtccagttccaggtcaaaaagaggcctttctgtgatcatgcaggccagcgcacgaaacagtacgggaaggcatatattatccaagtacagctcttcgtaatccgggcaggtggattccaacagatttacgatgcctggcctgtgaaaacttcggagaaaacgctgctcgtactcaatctgacttagataagccaggattaaatccaccccctttttcccgcactccatttgaaaaaccggatagtccaatgtcagaatatggtcctggggttgaaataccgggtcataccaggtgaaaaacgcgggcataccgcttacaatcgtctctctgtaatttttgcatccatagtcgtcaaagccttcaataatatggtgatatatctccttggcgcggcctgtcttctccagtacaatccggtaccctgcctcataggtggacgcagcccctgcccgctgcccctgaagcatatattctgcaggctctcccgccacttcattgatacaataaacgactgcttccataagctgttccgccgttttataggaaacagaagaactttcctttgatgtatagcgttcggccagttttgccacaacgggcagtaattcttcaatctcattgtgcatccgtgaacctccttccactgctttcccctttactcccagcacagttccctaagcgcctgcagatacaattctttgtcccagcgggtcacctcatcgaactgttcatactctccgtttccgccgctagccgtatatccacggtagcctgcacggactgccgcagtaaagacttccaggcatgtttcctccagatagtccagatctcctgcacagactgtctcaaactgttctctcataaaagtcagaacctcatcatctgtcatctgatccagcgcagcatttttgaattcataaaaaacatcctgcagccgttccaggctggacagataattatgctggctgatatactgtgaatcacagaaaacataaatcagttgatccaatattcccctcccgaattccaccctgccatactttttcaggctctgattcctgcattctgccagctctttgatatccgcctccctgagcacgagtccgaagcgctccgtcttctgattcattgcggacaataatgccagttcctctttcctctttgtcagttccagaagttctaaaatattcgtttccatgacaccgcccctttcccaattgatttttcattataaggccgcgccgcagactttacaagacttgaaaaaatacgcgttttgtggtaatataagggtagaaaatgaggcggaaatcaaatttccgcctcatttttattgtattttcctttgttccacatatgtcgtttaaatggcagattgttcactcttcatctgccccttcaatgatattccagatcagttctctggccgcttccacatcgctctcatctgcaaaaatatcctcgccgaagatggagtttcccgtatagatatccatgaggcctccgctggcaattccctgcctgtacgcctggatattatgctggcccaagatgtccaggatcatttctgcctctaccttatctcgtgctgtacatacttttgtaaccttcattccttccatactgttatcctccttaattacactgcagattcagctgccatctgccggtacgtgctttgaattattttcccggctttttcctaagcttcagagatatctccctccggtcagccatgttcttaaacagttgtactgcaatggccgcattttcctttaacgtgttatcttcattcacggctcccgatatctgttccagtactgctttaatatcatccagttccagaagattgactgccgtacagaaaaagctcttcctccgtccgtcattgtaattttttaataaaaaccgtaaaatttctattttttcatcaagcacagatctataatagtgtattccccgctctttagcacatgcaaaatcttctctgctgcgttttggcacaaaagaatcaaattcctcctccagatatctgtcacagggatatgcactgcactggctgcagtattctacattctcatgttccatgctgcagcggatgatctcacacgtgggcctgccttctccaccgcatccagtgcagtgtgattcctcactaatatgatacatggggcacagcccgcagtttaatccgcaaagagaaaactgggggtaaggtcttctgtatttctgcatctaaacctccctgctatgaccggatcagtacattaagacacataattatcaaaatatccctgcacaaggataaccggagttcccttatcaccagaaccgctcgtcaggtcacaaagtgagccaatcagatctgtaagccttcttggggttgttccctgtgccgccatatctcccaccagatcgtcttttttctctttgatgcgctgagagatggcctcttttaattcctgtccggataaatctctgaactcattatccgccaggtattttaacttcacctcattcggcgtaccttccagccccggggtattcgcaacggacacgcatgggtctgcaagttcccagatctttccgacaggatctttgaatgctccgtcgccgtataccatcacttccacatgtttccctgtcttatcaagaatacacttttggatttccagaatcagctcaccgcattcctttgtccgcgggaataacttgacagattcctcggtggatttattagatccgagaagtccgtatttttcattgcagccgcttccgttcaccggagagttcagcagatcgtccatgccgcagacaatctccgcaccgttttctttgagcagcctttttgttctctcacggctatgtatatcacagttaattacctttttggtatacttaagaatctcctgcggatggttggcgaagatgacctccacttctgcgccttcatttctgattaaatcgctgtaatactgcacgtaatccacgcccgtgaaacggtgtttgttctcaccgaacagctccctgtagcgctccagatccaggacatcactgtaaggattcacgccggccgcatccagcttatcctgggataccaactcgttccccacttcgtctgacgggtaactcagcatcagcacaacttttttggcgccccttgccattcccttcaggcagatagagaaacgattccttgacagaataggcagaataattccgatagtctccccgccaagcttattttttacatcctctgctatgttatcaacggatgcataatttccctgtgctctggccactatggattcggtggctgctataacatctctgtcacggatctcgaacccttcactctcggcagctaaaagtacgctgtctacgataatatctgccaggttatctccctcgcgtataatgggacagcgaattcctcttgaaacagttccaactcttctttccataatatagtcactccttataattttcttttaacttttattattttatcatattttcatcaattataccataaataacaacatctttattgtagttggcaggcttccatttcgcgctccagcattcactcccccctcccataaatgcaaactcacgtattttttaccttttctctctaaaaaactactctcttccgtctcttccaagtgttaaacttaacatagatcatgtggaaaagagggatttttatgataggaattggaattgataccggaggcacttatacggatgcggttgtatataatctggaaacgaatcaaatactggcatctgctaagtctctgacaacgaaagaagatttaaaaacagggatccacaatgtactggaaaaacttcccggtgacatgctctcctcctgtggggcgctttctctgtctacaacactcgcaaccaatgcatgcgtggaaaacaggggcggaaaaggaaagcttgtcttgatcgggctggcccgccagacgctggaatcttcttatcaggattacgggatcgaatcgctggaggacgtatatctgctcgaatgtgaactgactcccaagccctctaaaagcgttcagcccgactggactcagtttgccaaagacctgcaagactttgccggggactgtgactgtatcagtattgtacagctcttcgcaaaagagcatcacggtagttatgaaaaaagagcggcggaaatagtaaaatcggttcttgatattcctgtgattctgggacacgatctgttccccgacagaaatatgttacgaaggggcgccggggcgttgcttaacgcgcgtctgatcccagtcatccatgaattcatgaccgcggtaaaagcagtctttttgaaccatgggctttctctcccggtagtgattatgcgcagcgacggcaacctgatgtccgatgagtacacctgccggcacccggtggagacgcttctgtgcggacccgcggccagcattacgggggttcagcatctcgtctcggaagaaaacgcagtcatcgtagatatgggaggtacgactaccgatatcgccatcattaaaggcggggaaccactgagtgctaacgacgggatccagatcggagactggaagacctttgtaaagggcctttatgtagatacctttgctctgggcggcgataccgccgtacattataattacgacggcggccttttccttgagaattaccggatcatgcctctgtgcatgctcgcctccaactatcccggcatcaaggaacaactggccggactggatgcatatcccgagggacatactttcccgctgtatgaattcttcgtgcttatgaaagatgtctctgtgcatgcgcagtacacggaggacgagctggctctctgtgaagccttgaaaaacgggcctctgatgtacccaaatgcggcaaaggcgatcggaaaagatatctacggactaaaaactgcccgtcttgaggaggacggcattctattaagatccggtctgacaccaactgacgtgatgcatatatgtggggattttgcagcctttgacaaagatgcctccctggccggcgcggaatttattgcaaaatacgcccatatctccaaggaagaactttgccggaaaatttatgatatggtggaggaaaagctctactgtaatctgatccgtattctgatggacacggaattagagggattaaaacatacgatgtccgattcacagatagaaacgctgatccatatcagctacgcacaattgaaatcaggaaacggcgctttcttttcagcccgcttttctacaaaggctgttctggtcggcgtcggagctcctacacacatttttctgcccgctgtagcaaggctgctcggcacgaaagccgtgatcccaccccacgcctccgtggcaaatgcgatcggtgcgattgttggcaatatatcagccaccgccaccgccgaagtaaagcccgcctacgaggaggaagaaatgaacgggttccatgtcacaactgcttccgaatctgtcttttttgaagagtatgaggatgcgctaaagtatgctaaggaagcctccaaggcaatggcaatggagattgccagaacccagggcgccatcgggccactgaccacttcccgccgcatagaacgaaaagaagccgcaatcagcgccaatccgctcctgctctatgaactcgtacgcacaactgcaacaggaaaggccatttaggcttttcctgttctgttgtaacagtgcagttaagcccggatcgaagcggagcggatacctgtatgcctgcaaccactatgctttcgtacggtctgcgcagtaaatgcgcagacctgtctgaaatattacttctttttactttttttgatatttttcttgcaatttctaaccatattcttagaaaagtgtgttacacttatgatactaaaaattagtgaaacggaggcttacgaatggcacctttattatattccatcgtttcggaagatacactgcactccatggtagacacattttatgcctgtatgaggcttcctatccaggttatcgacgaacatggggagtttttggctgtaagcggacagatgtccagcttctgccgctgtttccaggactatcttccccccaacgacagctgcgaaaaaatgcatatatcagccagtaaaaaagcgatcacgcttggcgagccttacatattctcctgtcatgctgaattgaatcacatcgtgttccctctgatcagcaaaaagacattcctcggctctatcctggtagggccgtttttgatggattccccggactccatcctgatctcggacattgccaggaagtacaatattccaaccgatgaggccctggagttatacgatgaaacgggcaatattcccgttgtctcaccctccatggtcaatcatatcagccacctcttatattatctgtttgccaacctgatcgacgacagtaaagaagagctcaaacaaaataaccaaaaactgctccagcagtccaggatcaatgaatccatacagcgttacaaggccgaaaatatcagtactgcttcctatccttatgaaaaggaaaaggatctgatcgcaaaggtaaaggtaggcaatgtgcacgaggccaatgcgatactcaacgacctgctcggctatgtgctgttctcggagggaaacagcatcgagattgtgaagtcaagggctattgagctgtgttctctgctttccagggcggcaattgagagtggtgctcctactgataacattttaaaattgaataaccattttttgaaaaacctgcagcagattaccaccatggatacgctttgttttaaactgcaggagattgtagaggccttttctgaaagtatgtttaactacattccttccaaaaacagtgaactcgttaaaaaatccatgctttatatatcggaacattttaacgaacctattaccttggaagatgttgcctcccacgttcatctccatccgtcttatttttctaccatgttcaagcagtccaccggctcttccttcaaagagtatctgaacatggtgcgtatagaggaaagcaaacgcctgctttccaatacggatttttcaatcattgatatcgccgtggctgtaggttttgaggaccagagttacttttccaaagtgtttaagaagtataccggactgacgcctaagcagtatcggtagcaatttcattttccaatattgatatttttttataaataaacttaaaaaaagccaaaaaacagaatatttttcataaaaacctccccgcagttcttctatacttgagtcatcaaatacaaataaaaatgaagagagcctggaggtaatattttatgaaattgaatatgaaacagtggatcgcagatacaatcaatacaccggttaaaaaggcaatgccggtattatcattccctgccatccagttaatggacataacggtaaaggatctgatctccagcagtgatctgcaggcacggggtatgcagctggttgcagaaaacacagacgccgccgcttctgtcagcctgatggacctgtctgttgaggcagagtgctttggttcaacaatccgtgtctcagatgaagaagtgcctaccgtaataggaagtgtggtcagctcagaggaagaagcagacgctctggaaattcccgagatcggaagcgggcgtaccggactctatatagaagcaattgaaaaggcctcaaagttaataacagacagacctgtgctggcaggcgctatcggaccgttttcactcgccggaagactgatggatgtgtccgaggcaatgatttactgctatgaggaaccggatatggtacataccgttctggaaaaagtcacgagattcatcattaactactgtacagaatacaaacgtgcaggcgctaacggtattgttctggctgagcctcttgccggactgctctccccagcgcttgccgaagaattttcagcagattatgtaaaacaaattgttgatgccgttcaggatgacgaattcatcattgtataccataactgcggaaactgcacgatacagcagatcaactcaattatcgcaaccggatgcccgctgcttcattttggcaatgcgatcagcatggcagaaatgatgccgcatatccctgctcatatcgctgctgccggcaacgtagatcctgcttctcagttcagaaacggaacggtggagtccatcaaaaaagagacgaaagccgttatggaagcatgctgtaagtatccaaactttgtaatatcttcaggatgcgacatccctccgctttcaaaatgggagaatatacatgcattcttcgaagctgtcaatgaattttatgtaaactaaagcgaaaggaagaaaacggcttaaccggccgctttcttcctttttgtttcccccttttgctttttcattccggaatcaaaatcttatcattgtattttctctgaccaccgcataagtgatcccgttcagcttaatcttcggctgtatcatgacgccttcgggcgcatattttctggcagcccgctcacagacattatccactccggtgatcttttctacgaactcagaatgagaactgacggcttcgatttcctgcagttcgtcagctgaatacgttgcgaagggaacccggcactcttgtgcaagctccagcagtcctgcctcgtcccttttcaggtcaatgcttgcaagggcctggatctggcagagggatacgcccagctcttttaggaggacttccagcttttccttcagcctggccccgggggttcctcttctgcatccgacccctgccacaagattcctgggcggaagaaacaggatgtttttcccctcttttatctctgtccctgcatctgccaccgcaatccccagcggcagcctgcccagctcttccaggcaacggcagacacacagttcctccggcatcctgccctccaccggataagcactgtaaaacccgatcttctttccctccagtacagctgcggaaatctcctttgcaagcctgcggctcccgatgtgcagatggttttcttttgcaaatacatccacagcaaacttattctgtacatcggttgccgttgtaactaccggtactgcccccgtctgctctgcgaccagcattgccagtctgacagctccgcctacgtggcccgaaagaagcggaatcacaaatccgcctttttcatccatagagagcacggccgaatcccggtacttatccgccacccatggagcaatatagcggattgcaattcctgccgccccgatgaacagaaaggagcagctcccccatcgcaccccaatccattgttttagatcttgatccatcggattcataccgaatcctgcggcaaaacgttccgttgtataacttacgcactcgtaacctgcctttgccagcagcgcattcaattttctgttcagcctgcacccttcctccgtaaaactgaatatgacaatcggtttctcttcttttcctttattctccatatatatctcccccgggaactacaaaaaactgatctggtacccgctgtccttaagtacgccaagcgccttttgtaaattcctactcttagtcagtatatagtctgtattgtacgttgataccgcaaatattccgatcttatgccctgccagcaggcctgcgatcttagaaagtatcccggtcagggaaaagtccagggttccctggatgcggaaagcacgccagccattgtcgcaggcagccgcattggacgggacatactgtgaactgcagaccagggaattctcctcatccgtttttccaataaaacaaaattcatccttcatattcacctctgacagatctgttaccctgcacacagaaaactcctgcctcagcacctctattatcatatggcattccctcctgcctcttctttgataaaatggcgcaggtaatgcctgcattacccgcgccgaatcttcccaattacttctgcacaatatttatatccacttgaaaacattgattttacgccgtttttagctatctatcttctgatttactccatttttactccaaatctaagccaatattttcaattcggctacttcttcttttttcttttcttctgaaacgtgcgtgtataaatcagttgtcattgccagcgtggaatgacctaaaagtttctgtactacttgttggtctacgccattttcataacaccttgtagcatatgtatgtcgcagggtatgacaggtaaacacttcaaatatcttcggctctctcttttcttcctttgccagttcaatctctatcacattgattttcgctacatagtctttgattgcactattaacgttgtaataataaaccggcgaaccgtccgaacaggtaaataccaaattttgaaattctttatgctgtttccatatcgagcgtttccacatcttctgttctgtctgctttatcttctgattttgtaaaatctcatacacttcatctgtcatcggaattgcacgattactagacatggtttttgcagtcgtgtagaaaaacttcgaaccctcaacgggactggaagcctttgaataatggattgtcttattgattgtaatttttcttctttcaaagtcgcaatcttcccatttcagtccaagcacttctccaatcctacaacctgttgtcacggcaaatttaaaaacattgatgtgtatgtaggaagaagcaaatgtaaaaaatttttcctgctcctctcttgttaatacacgcctttcctttttcacttctttcggcatttccacaccgatacaaggattttttctgatgtattcactcaacactgccttatcgagcatatcgtttaacataaatctgatatttgatacagttccatgtgcaagcccattgtctaacaaatcattcaaaaacttctgaacgtgatatgttttaatgtcctgcaaatacatcttcccgatagagttcttcactcttgaattgtagtaactgtgatttttatatatcgtagtcattttaactgttttcttcttatacaactccgtccacgttacataccatgcatttaaagtgatactttcgccattgccattcaaaccatgttcatcttcataaaccgcttctcgcaacttccgtttcaactcatttagtttaaaatcataaagcgtttttcgtttccctgttttgcttgtaaatcttgcaatatagcgtccgtctgctctctgtgaaattcccttaccgagttctttgccctttaaatctttacccataccaactttcctttcttctactgaaagaaatatggtaaagtaaatatttcaattttcattatatcgacacctcattttcttttcaagcccttttgcattgatattccagccattcatcaagtaatttcttatttgcatacaaccgattaccaatgcgtactgtaaatctatttttaggattgttcaacaattctcttgcctttgttttcccaatccccatatactcacaaaattcatttatatttagtaatgctttctcgatacgattaccccctttcgtctaattttcttgcttttatgtaatcatcatacaactgcttttgtgtgatattcatttctccatttgctataagattagcaatataatctctctgctctatcttcccaacctctgcaaacagtttcaaagacggggcaacatatttttctaaccactcccataccttttgcagacttttcttctgtggttgcatagtaagtttgaccttgcctatgtctttcatcaattctgcccatgcccgataagtgggataaagtctttttcgtgttgccatactgtccgttggcttttctaaaaatcgtattttactgttcaatacttccattgccagccttaccacatctttatatctcaataattcctgtactacactaactgccatttcctgccgaaatctcaattcatatctattccaattttcatctaattctattccatattttttattctgctcatatcctttttcataaaacaccaatctcaaattactggctgaactaccgagataaagacttcctcctttactctgaaacacatcttctttcaattctcccgaatcgtgaaaatctatatcccgtaactttgaagaaagtaatccctcttttgtccgtataatcaaatcgggaatgctcaaatacggttttctgtcatctatcgccaaatcaatccgaggaaaattgacatgatactgacaaactctgttaaaaaaatcaaaccaagtttcctcattaagttgtaaaaaattctcatagttacgacagcctttcccactcattaaaatctgaaatccttgatactgtgcatttcctgttggttttagtaccttgatattatcaaagattgccacaacctcatgtcctgcaattcctttttcataacctgttaccgtcataagttccaacggtattctcaacacatcttctataactgcttctaacggaacttccttaatggttacctgacaccagtctatcaaggcacttaattcttctttctgtcgtattactcccctgttagtgtaggggagttctggaagaaaacttccgcttctttcttccaaatttcacatacctcctatcttcaatggcgttgtcattgccccaccctcaacctgccgtttggtacgacagaacgagggcaggaactttgaccacctacatatttttatttgaaacaggacggatacccttacaggtaatcttttccactaatacagggaagtttcctctctgcacataaggggcatatactgattcttccagttctaccaccgcataaggctcaatcttcggaagttccgttgcttccaagcgaatatccacgctgttcccaattttcatgcttccgagatgaagttttaaagcttccacttcctctgttttcttcttgctgtctttgtcatagtggtaacagttgtccgcacccataaaacgaagttctccaaatgcttcttttacctgttcttttgtcaatgtaatctgcatactcgttcctttctccccgttgaaccgataggtcagtttctcatattttcattttcctattacgacgtcgtttttgttcagttatttctaaactcatttgtatattagcacaagtatattcatttcgcaatagaaagtttagttttttatgaactttttgttttcttttttctgaacttatgatatagtgtccttagacgatacgatatgagaagttataacacgatatggaaagagaggtttttcagatgaatacaatcgcagaacggattaaatttgccatgaaagcaaaaaataaaaaacaagtggatatagtcaaagatactggtatcagcaaaggagcgttcagttcctatctttcgggacagtacaatccaaaagccgataaaatggaactgattgccgactctttagatgtggacttgagatggctttacggacaaaatgtgcctatggaacatacaagccaaaatgacaatgctctgcaatatgtcttttacaacaacaccttttccgagtatcttcttgataacttagatgatatatatattgccatgatgacacaatatgccgctcttattccacgcttttacgtacttgtcaatcgtgctggaaatgcaatgcacatacttccattgtttttaaaagacgatagttcccaattctacgaatgtccgtctgatttcttctattccgacaggcatactatttttacaagagattttgaaagtattcatatggtattaacaaccgccacgatttactattatggaattgatacaaagacgtataaaccagaagttaccaaacttgcctactcacaagctgacgattgcttttacatcgacaacggaatacaagacgctcacataaaagcatttgaaaaagaacaaatgaaagaagctctttacttaaaatataatgcccaataacaaacaagaggacttgcaaggtttctgacctttcaagtcctctgatgtatcatggtgctgttgattgtgtccgttccgtcaaggactgccctacggcgtatcggctacgccttgttccttgacctcactatgtatcattatcctacaaatcaaaatcacattttattgtctataagtttatttgctatacaacctataacattggtaagctctgtttcaaaatctcttgaaacatctgaagctccacttatagcatgagcacattcatgcaataatgtacccgcataactatttagttcattcaactgatttcgttttatcaaaatacgattctctttcggttcccacaatccaacagtttcattaaaaatctctgattcatatattttttctactatctgtatacattttacatttctcggttttccaccgattaattctaatatcttatccgttatatcatatactctacgttcagcaactgataatgaatctatctccacaatttgaggagtaaatctattttgttcttccttaatatattgatttgctgttactaacgtctttccttcttctgcaccagtattataatcttccattttgtttattaaattatctggtacaacaactggattatacccgtttctccgcatatcatctataagtgacggattgtttttcaaattgtcggtagttacatatgttgtcgccgtatttatttcactcattttcctagacgcatacatagctatgtcattccatgacaattcgtcatgtttattacctgaaccgaactcttgcaaatcttccaccaatttttttataacaatatccgaacaacaatcttttaaaatatctttgattctacctgtgtaggcagttcttccaacatttgttctttcacgattaagtgccttttttatttgagaatttaatgaagtaatattgtatgaaaacaaaaaattaagttcttccgctactctcacaccattaatataaatattactgtttactccgttgttagctaaaacctctccatattttgttttttctaaaaccttatcttctgtaaaagttaaaaacaaagattttgccttttctatatcttcttttgtacatccgtacaaacaaaaatctgttccaatcatctttatattatccgatggcagtatttctgcgtgtagagttattatatcatcaaagccaaccttagaagcagttttcaatttaataatcccatattttgattttattttcacatcaacaccatgacgataaagtgtcgctaaagcatctttcaatcctactccgaatcgtccaataagcttatcattactcaatttctcttcattttcattttgagttagatgatgataattcaatccacgaccgtagtctacaatatgccaccacccatcttttgcctgtttgatttctatatcccttgtatttgtaagtacctgctcatctaaggcattggcaataatctctcgtatcgcatgataattctcccagttttcaagtattttttcgatattcaaatcaaattctttaactttccccttatccaattcatctacttgattatcacctgcgatttccatatcgctttttcctttaaacgcatcaaatatacccatttattaaatctccttttcctttgcaaatactttactccgaatatgttcttcataattatactattttctatttttacaaacaactttccaccaaatttttttcataagttatattaaatttagacacataatatagaaataggagattgctattctttgttacaatctcctatttctatatatttacctttgaaatatttactccattttctttcgctttttactccaatattactccattttaaaaatctattacgatattttgcggtattctacgataccttttctttgtagaaaaatgtctgcaaaccttgattttcagcgaacttttcaatatttccaagcactttattctgttgtgagattttcttctcaaattatttcattacaatatttataatccttccgggcacgtagatttcttttacaatcgtccccgtcagtttatccgcaaccgcttctttcccggctgctatggccgtatctttgtctgcatccgccgcaattgttacaacggctcttgtctttccgttgatctgaacggcaacttcgatctcatcgtccttcatcttggactcatcgtatgacggccatcctgctttgaataccgtatccgtatgccccagctgttcccacatctcctccgcaaaatgcggtgcaaacggcgcgagaagtactgcaatgttttccagtgtctcctgatcaattccgccctctttcttagcgatctcgatcaacttgttattatgctccataaagccggagattaccgtattcaggctgaatgactccagacgggtcgtgatgtcatagaccagcctgttgcgctgcttgatcatttccttcgttgcttttatatccttgccgcagctgtccatgagcagattccagaggcgcttcaggaaacggttgacgccgtcgattccgcggtcatcccactccgcgtccagttccggagggcctacgaagagctcatacattctcagagaatcacatccataatctcttaccaggtcatccggtgagactacatttcccttggacttgctcatcttaacaccgttctttccagtgatcataccctggttgaatagtttctggaacggctcatcaaaatcaatggcccctatatcgcacaggaactttgtatagaagcgggaatacagcaaatgcagtaccgcatgctcaacgccgccgatatacatgtctacggggagcatctcatccgctttttctctggataccagttcgttctgattatggctgtctacatagcgcaggaaataccaggaggatcctgcccactgcggcatcgtattggtttcacgctttgcaggctttccgcagaccggacaagtacagtttacccagtcttcgattccggcaagcggtgactcgcctgttcctgtcggctcataggattctacatccggcaggcgaagcggaagctcttcttccggaaccggaacggctccgcagtccggacagtggataatcggaattggctctccccagtaacgctggcgggagaatacccagtcgcgcagcttgtagtttaccgttgcatggccgattccccttttttcaatcatatgcggcgcctcttttttaagcacagcagattccatgccgttccactcgccagaattgatcatagtgccggcagcatccgtgtaggcctctgtcatgtgttcaatctctacgccgtcttttgcaataacctgcacgatcggaagatcaaatttctttgcaaactcaaagtcacggtcatcatgcgccggtacacacataatggctcctgttccataatctgcaagtacatagtcagacagccagatcggtgtcttttctccgttcagaggattgatggcataactccctgtaaatacccccgtcttttccttatcctgcagacgatctacattggacttcatagacgcatcgtaaatatacttttctaccgcctcttttgtctccggtacggccagcgatgccgccagttcatgctccggagccagcaccatgaaggtggctccatataaagtatctggtctagtcgtgtagaccgtgatcttctcctctcttccgtcaaccggaaaatccacttccgccccgtaggatttaccgatccagtcggactgcatcttcttcaccttctccggccagtccagcttgtccaggtcgttcaggaggcgttccgcataagcagtaattttcagcatccactggcgcagatttttcttggtcacatccgtaccgcagcgctcgcattttccattcacaacttcctcatttgccaggccggtcttacaggagggacaccagttaatcgggaattccttctcatatgcaagaccttctttaaacatctttacaaagatccactgggtccatttatagaactccggatctgttgtattcacttccatatcccagtcatagagcgcagcgatctcatcgatctggcgtttgatgttagccacattctcagctgtggattttgccggatgaacgcccatcttgatggcatagttttccgccggaaggccgaaggcatcccatcccatcggatgcacaatataatggccctgcagcagtttatagcggctccagacatcggagatcacataacctctccaatggcctacatgaagaccgtttcccgaagggtacgggaacatatccaggcagtaatacttctgcttcttatttccgtcatcgtctaccttgggattcaccgggttctccgcccacttctccctccacttcttctcaattgctttgtgattgtacacaatcttagacattacaatatcctcctacattcaacactttataaaaagccttttcatctcattaagagacgaaaaggctttgacttccgtggtaccactctcattcacccggcagctcccggatgcactcatttcttctgtaacgggaagtcccgcttttatctactgctgtttcaataaaagaactccgaggcgagttgggagtttacgcttctgcctcacaccttccggcagctctctgaaaacgataggctcttagtactcctcatcccagtttctgcaatattcttatttattataggaagaatgttaaaataagtcaagtagttttctccctgatttcataatttgttgcacctgcgaatacttttcacgcccgttcaccatctaaaacggagatggcgtctgccttttccggttatagcggtcggccgcgccccccgcccatagggaaacaaaaacctgaggtaccagtgtcgcgatcgttgcagccgtaatccatgccccggaagacgttttcagtgttgatgtaggtattaaaatctatttcatccccatttgtttcagcctggaaaagtaatccctgctctccgcggcaactactccgctcagtgaaatcagagctacgaggttcggaagcgccatcaatgcgttaaaaatatctgcaatattccagacagcctctaccgtcatataaggtccgataaagatcgcaaggatatacagccacctgtaagttttcaccgccttcatatttctgttggacaaatattccaggcagcgttctccataatagttccaccccagtatcgtagtgaaagcaaaaaacacaaggcacagcatcagggcaaaggatgccacagccggcggaaacggcagtccctgctggaaagcagctgtcgtaatctccaccccttccaggcccgtattccacgtccccgcaatcacaatagataatccggtcatggtacagattacgatcgtatcaataaaagtacctgtcatagacaccaagccctggcgcgcaggctcttttgtctgagcagctgcggcagcgatcggggcgcttcccagaccagcctcattcgaaaagatcccccttgcaatccctttctgcatggcaatcaccattgttcccatcacaccgccggcaagcgcgctgccggaaaatgcggatttgacaatcagtgcaatcgcgcccgggattgccggtatatgagtcagcaggatgatcagcgccaacagtacatagagaaccgccatgaacggcacaacaatctccgatacctttgcaatacgtttaattcctccaatcacaaccagccccacacagaaggtcaggataattcccgtaatcacggttgcccatgagtatgtaccgccgaacaaattaaccgtgttggcgagatccggatcaaagaaattcttcacggcagaggcgatcccgttaacctgcgtaaatgtaccaattccgaacaggccgacacctgctccaaaaaaggcgaaaatctttgcaagccaccgccagttcttccccattccattttctatgtaatagaaaggaccgcccaacacatgtccttcttcatcaattgtacggtacttaatagagagaagcccctctgcatatttcgtcgccataccaaaaaaagcagcaacaatcatccagaataaagcccccggcccgccagcggcaatcgccgtagctacaccgacaatattccctgtcccgattgtagcagaaagcgcagtacaaagcgctccaaaactcgttacttccccacgtccatcttcttcatttttcaccatgaatttcagcgccttgcccagatgcctgatctgaaggcccttcaaacgaactgataaatagattcctgtcaccaggataagaatgatcaatggaagcccccacacggcatcatcgacccacttgataaaactgttgatctgactaaacataatattactcctccatccttttgcctgagagatttacagcacacgctgcgtacaccttcggcgctcttaaaataagagactctcctgagttgtcgtgtcttaacacgcaatttaaagcatatcaccaaatcctcaccatttcaagtactttttggggaatcagcgtgcatcatctgtcactcgatccacctactccgtctggccccccatccgggatagggacgccttcagctttgatgttccagctcttgagaaccggggtgtccggaggtctttttgcgcaggcttatactgattctggaaacctttaatgccgattaattctaactgcgaaaaagccgcatcttatggggaaaaactgatctccgaatcagtttttccccataagatgcggctttttcgcagttagcaattaacggctaagcggccggtttccagaatcagcataagcctgctcaaaaagacctccggacactccggttccaaagagcgtccccataccagccaccacaatctccctaccccaaagccacatctaatatcatcataagggtaaatccgattgccacccccactgtgctgatgtttgtatgcggttctgcctgtgcttccggtatcagttcttctacgacaacataaatcatcgctcccgccgcgaatgcgagcagatacgggagaattggcacgacaagacctgtcagaaggattgttatgaccgccgcaatcggttccactacacccgacaaagtgccgtaaaggaaggaacggccttttgatactccttcactccgcagcggcatggatataatggcgccctccgggaagttctggattgcgataccgactgacagggcaaatgcaccggcaagcgatatggttgtattcccggatactgcaccggcaaacgttactcctacggccattccctccggtatgttgtgcagcgttaccgcaagaacgagcatggttgactttttcaggctggatttcactccctccggctcgtctccattgagatgcatatgcggcgtcacggtatccagaaggagcaaaaatcccatcccaagcaaaaagcctgccgcagcaggcagccagggccgtgagccgttctcctccgccatctctatggccgggatcaacagggaccacacagaagcggctatcataacacccgaggcaaagcctagcagcgccttctgtagtttttcattcatttccttacgcataaagaataccatggctgagccaagggtggttcctgcaaaaggaatcagtattccaagcagcatgttctgattcatgttctttcccccattcatcttatagtttcatacgtatgaaactatcttatgcatggagtagacgatttgtcaatgaaatctatgtaagttctgcaagttctcttcctgctttctcgcaagcttctattgcttctccatccggtgcctcattggcaatgatgccttccgcacgcaccagctcagctccggctgccttcattctttctgcccagttccgcatccattcgccgtcgccccatccataggagccaaataataaaatatgcttaccggatacaagtgtttccagtgactccacaaacggctccatctcgttctcctccaattcttctgcccccatcgacgggcagcccagcgcaaatgcatgctcagacgctatttcaaccgcatctgccgcacttgcctcgatcagccttgcgttctttcccgccgcttctattcctctggcaaccgcctctgccattgcctgtgtattgccggttccgctccagtagacaactgatacattcatggttttaatcctccttattacacgcgatatcttttatgctctttcctgttaaaaattcgttgaccgcacatacttttgcctggtcatattccttgaaaatcattttcgcggccatcggattgctgtaaaccttccaatagcctaggaacagatattctcttcctgcattgcggataaacccctgtacgtcctccacgggatatccaaaaaagattccgatctcatgcggatatccgatctcctcccttgaaaataaagccgtgcggcaggacagcctttccaacatctcgtccagccccatttcaatgtaaccgaattcccggataaagcttctgatcccgacccggttcagatactcggataactctttttcacggtaaaataaaaccaggcatctcccctctgctgccgacagcctgcggtaagatattcctgacccgcccaagatattatacagctcattatacatagagtcctccattgtaattccgcaggacacctttttcccctttagaaacggtgcacactgaagtacaatctgaaaccgcagctttaaacgtatatcctcatgttttagaaaataagacagcacttctgcaggcatagcaccctcccttcaaatgattatgattctcaattaaatgaattttaccacacttccgtcagctattcaatcccactatatgataactattctcatttacctcaaagcaattctgtactttttccttcccctgttttatatggtgaaccctttcgataaagttggaatttatcctttttttagttgttaccacccgtactttagtgtataatgaattaaagacatttgagcattgagaggtctcaaaaaaacatacataaaggagagattcgccatggtaaatttaataacaggcccgaaaggcagcggcaaaactaagcagatgatcgaacttgcaaacgagaaggtgaaaacttccaatggaaacgtagtattaattaaaaagagccatcgtgatacatacatcgtggactttcaggttcgcgcaatctgtatggcagattacagagatattcaaacgctggatgaatttatcggatttatatacggcatggtagccggtaaccacgacattgaaaccattttcattgacggagtattaaaacaggcagatatttccattgacaacctgtcaaaattcctcgaaaaactgaacaaaatttcaaaagaaaacaatattgaatttattatcagtgtcagcgctgagagaaaagatataccaaacattgattcaccggattatgccgttctgaattaatgagaccaaaaagggtgtatctgcggatctcgacctgcctggtacacccttttattttaacctgttttctcatttccatcctaagaaaattatgccctgttttcctcacatccgggcagtcacattttttcaagaatcccaatcgatcgaatcgaatatttgataactgaattctgtgcatagatctttattttaacgggctgattcggtaaaacgcgctgtttaaaaaaacagcggatatgactacgtccatcatatccgctgcttactcttagtgaagcgcttttattcctgtactgtgccttcctcagcctgcgctgtatcgtcctgctgcccgttgtctgcattttccccgtcggaagacggtgctgtcttctgcagttcttctccgttgaaagaaagaactgtattggtcgtatcaccctctttatactccacagttacttcctgccctacttcatattttataatatctatgaagtccactactgacacatcaaagatctcatctgagccttccagcattacgtagtagtgagaattaccgtcaataactccctgcgctatttttgtaatcttcgcagtaattgtctcaatctcacgggtatctttttcaacctctttgattccgttttcatacatcaggttcgtataagcagcctcgcacgagcttaccgtatctccgattgccacaatctgatatttctgtacgttcaccatcgcatattttttaaccagccccgcatcatctttaagggcgataaaataagtcggttctccggaaatattcaaaagcagcgggaaggttgccttatacttcaggttctgtacctgtccttccgccgaggacattgcagagtcttctgttgctccctcaatgccataaaactttgtctccattgtccgctggttcatcagaacaaatcctacattggactggtcaccgctgacagaagtcacgccggtgtatacccacacgtcatcgtcaattgcaaggtaattgtaaccggttgttgtcttcagacagtccttttgtcccaggatgctgttaaaatagccatgctttaatgatccgtaatagtcatacagttccacaagcagatcagccgagtaagccctgtctatccattccggcgcatcttctatcttatagtcctttgtctctcccgtaatggcattgcacaacactacgcggcctatggtggttccaccgaaaaggccgatgttaaacttcttcaccgggcagatccagtatggaactccgtcatcgtcaatttcaaaactgaggtcattaaaaatatacgtcggatacttaaatctaagatggcggtaaatatttctgttaaagtggtcgcttgtcgtatacttcatgccctctttcagcttcacaagttccgtattctgcgttgccatatcaatttttatatatgccggtatcccttccttctggtttgtaagccatttgatcacgctcgcataacgcagcggtgaaactctgaccggctgatcctggtaattaatctggctgtacagatcatccacctcgaactgagataccatgtccaccatgctgcccattttacggttaccgaggattgcagcagaatccctgtccagaagcggaatctggtcaaaagacaattcctcgatatctttcgtgaactcaccgtcttttacatccagaagtttctgatacttcttcgcatttacaattggtgaagatagcaatgtgccaatcaaataagctgctaccactaccaccaggattcccaaaataacttttacgcctttcgagtttttcagttcataccggttaagcttcttccttctgatgtaaatcaaggcagcaataataataatcactataaaaaacatccagaaatctgaggagtggatattgattgccggcagcgttacataataataaatcgcagcaagcaatatgattcctatcacagccaacagttttactttcccttttttcatacattaccctttctgtctttcttccttaagtctttaagtactctccggcatgttgccaaagttctgtcagtttccgagatttattagaacctccttctccacagatccggagaaagaagcagaagatacgggaatatctccaatcttcctatcagcatatccaggcagaacacaattttggacagaggtgaaaagccagaaaagttttcaatcggccccacctgagccagcccaggccccacattattcagtgttgtcaatacagaactgaatgttgtcgtaaaatcgtagttattgatggaaaccagcaatacagataacatcattatcaggatataacaaataaagtaaatatatacaccgtgcatggtatctcttcccactttttttccgtttatctgcacaatcgtaacggacttgggatgcagcattcttctgatctcctgctttacgctcttcattaatatcagaaaacgagatacctttatcccccctcctgtagaacctgcacaggctccgatcaccatcagtcccagcaggattaccttcgacaattcgggccactggtcaaaattggccgtacagaatcccgtcgtcgtaatgatcgcccctacctggaaggaggcatatcgaaatgcatgcaaaatattgccgtacatccccatgatattcagcgtaataaccgccatggaggcaagaattatgcccagatatccacggagttcttcatttttcagcgcggccttccaatttttcagacgcagcaggaaatagatattgaagttcactccaaacagaatcataaataccgtgatcactccgtcaatatatgcactgtcgtaataggcaatacttgcatttctatttgaaaatccgcccgttccagccgtactgaatgaatggatcagcgcatcataaaagctcatgccgccaaaaagcagaaaaactacttccgctgcggtcagcacaaagtacatggagtacaaaatcttagccgtgcttctcgcctttggcacaagcttgtcagcctccggccccggcacttccgcacgcatcagatgcatagaactctcatcatccagagaagtcagcatcataacgaaaaccagcactcccattccgccaatccagtgcgtcaggctccgccaaaaagccattcccatcggcagggcctcaatatttgtcaatatggttgaccctgttgtagtaaaaccggacacggtttcaaaaaatgcgtccagataattcggtatgcaccctgatatgaaaaacggcaacgcgccgaataatgaccataatatccaggcggaacccacgataacaagtccttctttgccgtaaatcagcttgttgcccggttttttccgtccaaatatcaggaatatgatgagaagtactgcacttaccatcaaaaatgataatccgcttttttctccatataaaaaagcaaccgctgccggaagcaggagaagcgcaccttccacccccagcatcttacctattatgaaagttgtcattctataattcatcgatctgcacctacagcaaaatatcctggatatcctggatatgtttttccattgtaatgataataacgctgtctcctacctgaatgcagtcatcaccgttaggtataataattttgcgctttctcgcaatgcatgcaatcagattgttcaccttcagtgacagatcctttaatggaatgcccgtatagtttgtctgagatttcactataaattcgagagcctccacttttccgtcgaccaattggtacatcgtttccacattcgcgcttccctgagagttcctgcgggcacgcacgtaactgagaattgcatccgccgtagcagccttggctgacacgatactgtcgatgccaaattcctgtatcattctggctcttctgtcttcatttaccttgacaataatcttggaaacaccctggctctttgcaaagagtgacataatgatattttcttcatccatccccgtcagggcgatcagtgcatccgcatcctgtatcccctcttcgatcagaagatcatggtcggtagcgtccccgtttatgaccgtcgccttgggaagaagttcacacaggttttcacatttcttttcgtctatttcaatgatcttaacctgcatcccaatcttgcagagctgtgtggaaaggtagtagctgacgcgcccaccgccacagataattacctttttaatcttttcttttctctgacccagcagtttgaagaacagctcaatctccatgtgagaagcagctatatgcagcctgtccccggctcgcagcacataatcaccatccggaataaagacttcctccccccgctctaccgcgcagacaagaagcttaatctgaaatctattatacatatccgccagtgacagcccaatcaggcagctcttttccaacagaggaagttcaatcagttctactcttcccttgacaaatgtatcaaccttacttgcatccgggaataataagagccggacaatctcccctgccacagccagctccgggtttaccgccatactcagatgtaagtcttcttttaatatatcaatctgctgataatatattggattacgcaccctcgctattgtgtgccttgcccccaatcgtcttgcaatcagacagctcagcatattacattcatctgtggaagtacacgcaatcacaagatctgcatgcggaacatctgcttccttctgaactgccacacttccaccgtctccggtaacgcaaaaaatatccagcctgtcaatcgcggcacgcagctttttctcattgctgtcaatcataataacgtcataattttccgcggagagttgttttgccagcttatagccaacttttccatccccaataatgactatcttcattcgtctgccctcaacttcattacttattatattttggtcatttttctataatggcagagcaattatagcacttttaactgcaaactacaatcgttttccagatttcttaacaaatttcaaattaccgggtgcgcaaggggggatttaggcgggtatggggacgctttggggaattggaatatgcctctctcgggtgcggtatcagggcataaatgccgctaatcaaaaccgggggaggcggattatgctgaactggtgggactgcaattgtttgggaaggaaaagtacgtatgctgatttcggaagccttaagagtgccttagaagttcttgtagcggaaaagccgcatcttatggaggaaaattgattccgaatcaattttcctccataagatgcggcttttttactgccagaacttcttggctaagcagctgatttccaaaatcagcagactccttcccgcctcctactcttcagctcttgctgcgatttctttttcctgtacgtcggatggcgcctgctcatatcttgcgaattcgtaagcataggttccacggccacctgtcatggaacggagtactgtacagtatccgaataatccggtcattgggatatcggcctctatgacctgtttgccgcccgtgatcgggttcatccccagcacgcgtccacgtcttttgttcaggtctcccatgacatcacctgtatattcgtccggtactgtaacctttaaggaagcgattggttctaaaagtaccggtcctgcttccataaatcctttcttgaatgcctgcactgttgctgtcttaaatgccatctcagaggaatctaccggatggtaggaaccatcgtagagaactgcttttactcctacaaccgggtagcctgcaagcgggccttttccaacggaatcctgaagacctttttcgactgccgggaagtaattcttcggcaccgctccgccgactactacttcttcgaatatatatggtgtctccagatcccctgacggctcaaatctcatcttaacatgtccatactgtccgtgtccgcctgactgtttcttatacttagtatccacgtcagaattcttgcggattgtctcccggaatgcaacctttggcatctccagtataatctcaactttgtatctgttcgcgagcttgctagccgtgatctccagatgctggtcccccataccataaagtaaagactgacggttttcgctgtcatttactgccttcagtgtcatatcctcggccatcatcttagccagtgcctgtgacactttatcatcatcccctttgttctttacggaatacttcatatatgtatacgggatggagaagtctgtcttagcgtaggaaacctgcgttgcttttgtagaaagagtgtctcctgtccttgtattggacagctttgcaattgctccgatgtctcctgcaaacagttcggtaacttcggatggtttatttccgcaaatcgtatagagcttgcccggcttctcttctgcgtccgtatctgcattgaaaagaatatcgtctccctttaatacgccggagcacactttaatcaaagaatattttccaataaaaggatcgaccattgtcttaaacacataggctgtctttgcttttgagaaatcataattcgcctcaaatatgtcattggtcgttctgttaattcctgcacagcttcttttatccgggctcgggaagaacctgacaatatcagaaaggagattggcaacaccctgcgcctgaagattggaacccattcctaccggaacaatatctccgtccataacttccgtacgcatagctgcccggatctcttcaacagaaaactcttcccctgaaaaataccgttccatgaaatcttcacttgtctctgctactgcttccatcagggagtctctcagtatctcaaggttcgccttgcagtattcgggaatctcgcattcttctctctgtccaatcccagtatatcttctgcctgcgttcttaatcacattgatatagccaaccagcttttcattctcgcggatcggctggaagtgcggagctatctttttgccgtatctcgctgtcagatcctctacaacctgacggaaactggcgtcatccacatccatctcagtcacatagatcatacgcggaagattgtacttatcgcataattcccacgccttctccgtcccaacctgtacacctgctttaccggaaactacaattaccgctgcatctgctgcactgactgcctcctcaacttccccgacaaagtcaaaatatcccggcgtgtccagaatattaatcttggccttttcccactcaataggaatcagagatgtgctgatagaaaaaccacgcttctgctcttctttatcaaaatcactgaccgtattattgtctgaaatcttacccattcggtttgttgcccctgatacatacaacattgcctctgcaaggctcgtcttgccactcccgccgtggccaagcaatactacgtttctaatctcgtctgttctgtaaaccttcatgctgctgcctccttgtgtgtcgttattatgtgcatggtttctatcatactcgccgtgcacacgtattatgtgtatattgtactaaaaaactaagaccattacaactcctttatgaatttttaacaaagaatttagggggaatgggcgggaaattttggatgaagggccgcatccaggcaatcccattccccttccccgtacgctgggttcatccaatttttacagggcaattcccagggggattcttccgggggcagcgtatttgatctgctgggcggatatttttgtgctgtggttggggatgatatttatacgcaaggcctgcttcatcttattatttattcgctgcagcagtaatatccacttttttattttctttgaagcctgccatgcatactcccctaccagccagtcccatccgctgctcccctcccgccttagggcccccagcatgccaggggccgtttgctgcagtgcattattcccggcccgtgcaatgtgcggctccagggggacgtctgccggttttgtgggcatagaataagcttagaagcgcttaatgccgtaccggaggattttatggatgggagctggcttccaggccggctcccaagcggggtctgatccgtgcaatcatcagattgcacggtgaatccccgtggttccataaaatcctccggtacggcatttaccgcttcttagcgaatgggcagcccccaaaaccgacagacgtccccctggagccgcacattgcacgggccgggaatagcactgcagcaaacggcctcctggcaggcggccccccccctcctttttatttactttttggggaggaggtgttaaactgtttttgtatgttttgtatttgattttactgaaaggaatgaatcaccatgactaaaaagattggcttcatcggcctcggcctgattggcggctctatcgctaaggctgtcaggcagtactatcctgattatgaactgctggcctttgacaaaagtaaggagacactggcactggcagttcaggaaggtactattcaaacttcctgttcttcaattgatgagaatttcagagggtgcagttacatttttctttgtgcacctatttcctataataccgcctatcttacacagttgaaggagtatatccatccggactgtattctgactgatgtgggaagtgtaaagacttcgattcatgaggagattacccggctggggctagaagataattttattggggggcatcctatggcaggctccgagaaaagcggattcgtgaactcaaaacctgtgctgattgaaaatgcctactatattctgactccttcttccagggttccgaaagaaaaggttgcagaatataaaagttttgtggagtccctgaaagcgcttcctattatattggattataaagagcatgattatgttacagggacgatcagccatcttcctcatattattgcgtccagcctggtcaattttgtacgggatactgatacggaagatgaacttatgaaaaacctggccgcaggaggttttaaggatattaccagaattgcttcttcctctcctgtgatgtggcagcagatctgcctgaaaaaccagaaaaatatttcccggatcctgggggattatattgaggttctgaaacaggcaaaggagtccgtggatgaaggctcagaaaacgacctgttttccctgttcgaatcctccaaagactatcgggattccatgcccaacagttctgccgggcctatcaagaaacgctttgcggtttactgtgatatcatcgatgaggcaggaggaattgccaccattgcaaccatactggccagcaataatatcagtatcaaaaatattggtattgtacataaccgtgaatttgaggaaggcgtactgcgcatcgaattttacgatgaaagctcttcagctaaggcagctgaactgctgaaaaaataccgttacatcgtctacgaagtgtaatttgcataagagaaaggatttttaaagatatggaattaacaaatattacgggattaaaaggagaagtggccattcccggagacaaatctatttcccaccgctgtgttatgttcggctccatcgcgaagggaatcaccgagattcataattttctggaaggtgccgattgtctggctaccatcgactgtttccggaaaatggggattgatattcggcagtccggggacaccattacggtgcatgggaagggcctccacggtctttccgctccttctgagatcctggatgtaggtaacagcggcacgacaacccggctgatttccggaattctggcaggacagtcctttgattccaagctctcaggtgatgagtccctgaattcccgccccatgaaaaggatcatcgagccgctgactctgatgggagcaaatatttccagcatcctccgcaatggctgtgcaccgctgtacattacaaagggggatctccatggcattcactatgattctcccgttgcatccgcacaggttaaatcctgtatcctgcttgcaggcctgtatgcagacggcgaaacttctgtgacggagccgagcctgtcccgcaatcatacggaactgatgcttgccgaattcggagcagatgtctccacgacgcatgatctcagaagtacaaaagcgacagccttactccgtccatgtaaagaactctacggacgcacgatcaccgtaccgggagatatttcatccgcggcctattttatcgcagcggggctgctggtgccgaattcagagattttgattaaaaacaccggcatcaatccaacacgtgccggcatcctgaaggtttgtgaagatatgggcgcagatatcacgcttttaaatgaacgtattgaaagcggcgagaaaattgccgacattctggttcgtacaagccgtctgcacggtaccacggtggaaggcgatatcattcccacactgatcgatgagatcccggtcattgcagtcatggccgccatggcggaaggcactacgattatccgtgatgccgcagagctcaaggttaaagaaaccgatagaatcgagactgtcaccgacaatcttaaggcaatgggatgcgatgtaacgccgacctcggacggcatggtcatagagggtggaaaaccgcttcacggagcaacgatccacacccttctggatcacaggattgctatggcattcagtattgctgctcttgtagcagaaggcaatacgaatatactggacagccactgcgtggatgtgtcctacccgaccttctacgacacttttgaacaattactctaaaattacatctgcacacaacacaaaaaaccgggccatgcagtcacagagactgaatggtccgggtctttttcacaccgcaaacgcttcaccgggatcctctccggcattcgcttcccgtttattgactctgctcaaccttctccagcagctcacgcactgtcttcccgtttccaggatgatgcttatatggcgcgatctcatgaaggggcttcagcacaaaatcacgtttgtgcatctcgacgtggggaatacaaagtgtatccgtctccacaatcagatcatcgtaaaaaataatatccaaatccagggtccttggcccccagtgtataatgcgctcccgcccagcatgtgcttcgatcttatgcagctcctccagcagttcctccggcggcagcagcgtccgcagctccagacagccgttcaggaaatcatcctgctctgtcatgccgtaaggcggggtaacaagccagccggaggttttcactacccggcagtcctctctccgatccagttctctgaccgcagcattcagatagccttctttgtcccccatgttagatcccagggcaatatatgccgtatgccactgcctggcaatcctgactgacacgtattccaccggaaggcccagaggagcccacggctttttcacctccagctccaccttctccagatgtgcagtatgcataagaagctcctctgccagacactccgcggcccgttcaatcagcttatacgtattcttcttcataaaagtaactataaactggctgacctcgccataatgaatggaagccgccaggtcatctgtctttccggcatgcctggtgtccgtataaagaaccgctgagatcaaaaacttctgccccagcacattttcctccggaaatacgccgtgattggcaaatacctccagattttgtatcttaatctgatccataatcccgtccctctatatgtcgttttctcaaaggggtcagacccctttgcagtcatgttccctcataatagcttctgtcatctgaatggcccgtttgtttcccttcacatcgtgcacacgcacaaaggaacaccctcttagtatcccaagcacggtggttacgagggttccctcttcccgctggctggccggcagatccagtgtcaggccgattacggactttctggaggttcccagtaaaatagggtactccaaaaatttcagacggttcaattccttgatgatttccagattcatctcatacgtttttccaaagccgacccctggatccagtatgatcttatcttttgcaataccagcctttcttgctatgtcaacactttcctgcagatccatcagaacctccggcagaaaattcacgtattctgctttctcccggttgtgcatcaggcaacacgctgtctgactttcagcgattacgtccgccatcccggcatcatatttgagcccccaaatatcattcacaagagcagcgccggcctgaactgcagcttttgcaacgctgctcttgtaagtgtcgatggaaatgggtgtgtcaaactcctgcttcagcctttctatcacgggcacgacccgctcggtctcttcgtcctccgtaatctggatatgccccggacgagtcgactctccgcccacatccagtatatccgcaccgtcacgcaccaattcctgtgcatgcagaagcgccttgtccagatcattgtacattccgccgtcggaaaatgaatccggcgtcacgttcagaatccccatgatataggtatgatgttccgtgtcaaactccctgctgcctattttcatctcttataccagtcctttcaccattttatctccatattcttcttttcactgctccagttgcattccttctccgccgggcacgcataacatgctctggacaatttatcactttcatataaaagtctgccaagcacagactgattctcactgtcccgtctgtgctccagaattgcctgaagaatcatctgtctttcttctcctgtaaatgtatccgtatcctccagtatcttttctgccgtctcttttccggcggtctcgtggggtatgccttccgtatactggctggccttgccgatatcatgcagaattgccgccgcgtagatcacctctttcttcaaccccagtccgttctccagactccggatatatgcgatccgggccacatccagcagatgcgtcatctgatgcctgcagaaccgccggtcccgttccaattcctccaaccgcttgcagctgcttagatacaaaggatgctttctgatcaattcaatctctttcatatacaaaatcccgttcctttatctgatcatctgaaaaaacagattggtcaactccggatcctccagaaatacgcctctcttaactactgtcacggtctggctccctggttttttgattccccgcattgtcatgcacatatgttctgcctctatcatcacaagtactccttttggcttcagatgctccatcagggcatctgcaatctgccccgtcagctgctcctgaatctgaagccttctggcaaatgcttctacagttctggcgagtttgcttaagcctactacctttccgtcgggaatatatgcaatatgggcctttccataaaagggaagaagatgatgctcgcatgtagaataaaaggtaatatctttttccatcacgatttcgttattgtctacgtgaaatgtctttttcagatgctctgccgcatcttcttctatcccgccgtatatttcctcatacatccgggcaatacgctccggagtctcctttaagccttctctttcggcgtcttctccgatcccttccagaagaagcttaaccgcctgtttaatcttttcctgatctatcataacttctctcccatatcctccgtcaattccataacccgtcccagataggacagcgaaccaaatgccagtactacatcgtcttttctagcagaagcacaggcttccctcacggcctcttctatcccggatgcctcttctaccgcccccacacagtaaggcagcaatgcctgctttaattcatccgcgcccagcgtcctgccctgatccggcagctccacagtatatatcttatccgccagaggacccatgatctctgctatcttgtcatattccttatcccggaatactcccataataaagagcatgcgcctgctggggaaatattgtaccagagactcccgcagtctcagcgccgcttcctcgttatgtgccccgtccacaagcaccagcggatccctggcaacacaggtcagccgtccgggccatgttgtttttgcaaaaccttcctccacagcccgccttgagatctcatatccccggtttctaagtgcccggataactccaagaactgttacggcattctcaatctggaatctgcctgccagcgaaattctgatattttcccactcccggtaggaaaaccgctgtccatcccagttttcttctaccattactgcctccctgggatacacaacctccatgccgcatttcagctcccgggccttttcgacgagtaccgtcatcacttccggcttctgcagcgatgtgacaactgtacagcccggctttataattcccgccttattagccgcaatctcctccagggattcgcccagaaagcccatgtgatccctgctgatggatgcgaatacggcaagctccgtattcttcacaatattggttgcatccagcagtccgcccagaccggtttctaaaacgactaagtcgcagcgcctctttctgaaatacaaaaaagctactgccgtctctgcctcaaaaacggtggggctggcctcacctctggcttccatacgtgcaatagctttcttaacttcttccactaattctgcgaactcatcttccggtatccactttccgtctatctgaatccgttccaaataggaaaccactgttggtgatacatatctgccggttctataccctgcctcacttaaaattgttgaagtgtatgcaagcacagatcccttgccattcgttcctgcaatatgtatgaacttcaggtcatcttgaggatgcccaagttcacgcaacagacctcgaatcgtatccaagccaagtacacttccgtatttcgacacttcgtccaaatatacccttgcttctttataggtcacgtttctcgtttcctttctctatctcttctataaattatgtaattattcagtttacgctgcagaataatgtattccactgttgtcaatcatagcactaaatgcattttatcacaagagaaatttattctcgccatcccggtactgccggggcgcattaaacaccttccctattccaaagaaggtacctggcaccagacatccagtatctccatcatatttaccgggccgtgctgcatgttctcccggttcttggtattttctgcatccatccatgcaaaaaaacccgcaggcagtacggaccattcctccatctttcttttaaacttttccgaaaaatactgttcattttggaacacagtcataattaccaactgcacacagttatccagcacaaaacctttatacgcctcttccccgctccaataattttcaaaaacatattttagaaaagacagcagacgtcccacaatttcgtccagaaagccggctcccgcactcagcgtcatcaaggtctgatgtccgtttccggcatcctcatccacgtcctgcaaatcatctgcaagctgcaaaaagagcccgaatcccgtaagaaacaggacatctttttcctttagattcccatcaatcatgcactgatccacatagatagaagccccgcccttataagctgacatctgcagaagctcttccgccgttttctccgtctttccctgctgctccatacttttaatctgggcatcataaatggtcagcagaaaatcataaagtccgctgaatatttttctgggataaatatcttcgaccgaatcaaccatggagaaaactttctgttccagatcgtcttccgcctctgttttgattccgttcagtttctgctccagcctgcagttaaatgcagccttttcctgtctcgttttttcaccgtccagaaaattatccgtataaggataaagcaggctgtacccccagatcgcctcatggaaccacctgtcagaaccatccgcaaggcacagcataaaatatacaaaataatttctcagtgcctgtccaagatcctccagtacaagttccctgtcaaacactcgcgtatgtcggataaacgttctaaccgcctctaggaatccgttcctcacatcgcccggcagccgccccagctggaacattacatccttatccatagcgtcggacaaggctttctccgccttctcccgccacatcttctgaccgtgaacggcctgagggaagctttgcaaatgcccgttcagcttcccccaaacctccctgcaccgtttatcattttcagcccgctcttttacagaaatagcacggaacatccacgcacccgctaccgcaggagttttcttccaaacatccgtcacggtcttcaccgccgcagtaattctataccgatcatcctcccgaatcgtttcccaagtatccataatatgccctcctgtaaaaagccgcagccgttaatacactccctgttcccaatacttcaaaagtatagcacgatcctccctcaaaaacaactaaaggaatgggactgttatatgaagaaaagggagcggaaatgaaagggataggcggaaaccttccctaatccgacttgtctatctcctgtctggccacgatatcacctcatactttcaatatcattccccttccgctctcccgtcctgaatcccatcccgcacagccactaaaaggtaaggagagcgcccgcctctttgggctgcgggatacggcgtggggcaggatgtcttccggtgattgcggatgcctgaagtgtgccgtgtttacgtagggataaaatagaaaaatctgatggacagactttgctttaccaagtaaagtctgaggcgactaaggcccccaattatcaaattggggatcgcatgtcgccggttccatcagatttttctattttatccctacgtaaactaggcaaaacggccggcatccgcaatcaccggaagacatcctgccccacgccgcatcccgcagcccaaagaggcggacgctctccttaccgtctcgtcagctgtaagctaattcacctcattatgcagcagtttatgttcttttcctttcaatatgccctcataagccgcctcaacgatcggattctggtttgaaagtttgatctgtgccattgtgtcgatcttataaagtccttccagtcttgctttctttgtccttgggccgatcggcacaggctgccctcctccggcgatacaccctctcttacaagccatgacttccacgaaatcatagtgcacttctcctgctttcatcttctccagtacttcggaggcgcattgcagaccattcacaacagcgattttaacttctctgtctcccagttttaccctggcttccttgataccgtctacaccgcgcaccccggtgaaactgattgcttccaggtcttccgccttattgctgttaacaagacgccgcagcactgcttctgtcacacctccggtaaccccgaagattgcgcctgcgccggatgccagtccaaatggcatgtccagtgcttccggcttcacctgtgcaagatcgattccagcttcctggatcatccgggtaacctctgtggttgtcagcacataatccacattctgctccccatctgtaaagtgttccggtcttgtgatctccgctttttttgcggtgcatggcataatcgagataaccatggtcttcctggtgtcttccgccgccttcatacgtgcctcttccttaatcaatgcgccgaacatctcctgcggagaacggcaggtggaaatattcttcctgaattcaggatatctattttcacagaacttcacccatgccggacagcaggatgtgaaaagcggaagattttctcctgattccaggcgttccagcaattctttggattcttccataaccgtcagatccgcgccgaaattagtgtcgtatacttcgtcaaaaccgatacggcgaagagccgccacgaggcgtccaagcacattttcaccttttttgatgccgaacttatctcccatagccaccctgaccgccggggcaatctgtacaaccacacggacattcttgtcactgagcgcacgccataccggatctacgttctgtttaatcgtaattgcaccggtcggacataccgcgcggcactgtccgcatcctacacaatccgtctgcgccagatccttgttaaatgccggcgtcacctgcattttggaaccgcggaatgcgaaatccaatataccaaggccctgaatctcgtcgcaggttctaacacagtcaccgcacagtatacacttatttggatccctcacaacacactctgatgtcgtatctttctccagctgttttttattattttcaaaccttacatccataattccaagctgtctcgacagcttctgcagtgtacagactccgtttttagcacaggtagtacagtcacggcagtgggatgccagaagcaattcgataatcatctttctgtggtgctgcagttttggcgtatttgtataaatcaccattccgtccctgggtgtctctgaacaggatgcaaatatccttcctctgttatcctccaccacacacatacggcaggcaccgtaggtagatagctccgaatgatagcagaaagtaggaaggtcaatcccggctctgcggatgacggaaagaacattcttttcattcgtaaaggcgacccttctgttgttgattgtcatataactcatgttcgtttcctcctacccttcaatatgtatcgcaccaaatgcacaggcgctctcacaggcgccgcacttaatacatttttcattatcaatgacataaggttctttaatctgtccgctgatcgcacctaccggacagtttctcgcacatttggaacagcccttgcatcgttccgggctgatgataaactgccgcattgcggtacagttgtgggatacacatttcttctcaactacatgttcctcatactcttttctgaacagcttcagcgtactgatgacaggcagagccgcactcttgcccagaccgcacagtgctgtgtccgtaatagtatccgcgagctcctcaagcagatccaaatcctccaattttccatttccggccacgattctttccaggatctccagcatgcgctttgtgccttccctgcacggaacgcattttccgcagctttcattctgcgtaaagttcatgaagaaccttgcgacctccaccatgcaggtatggttatccattacaaccagtcctccggatccaatcattgcgcccatcttcttcaaggaatcgaaatccagattaatatccagatgcggcgtaatcagacagccgccggagggaccgccgatctgtacggccttaaattctccgtcccccttaattccgccgccgatgtcataaataacttcgcggagggtggttcccatgggaacctcgatcagacctgtgtgctttacacttccagtgagagcaaacgccttggttccaggactgctctccggtccgatgcttttaaaccattcagcgccttcgttgataatcatgggaacatttgcaaatgtttctacattattcagtacggtcggtttcgcaaacaggccctgttctaccgttcttggaggcttcacacgcggcatgccacggttcccttctattgaggctgtaagagcactgccctcaccgcagacgaaagctcccgctcccctgttaatatgtaaacggaaggaaaaatcagtacccagaatgtgatctcccagcaggccgcattcttctgcctgtgcgatcgccagtttcagacggctgatcgccagcggatattcggcacgcacatatatatagccttcggaagcgccaacagcataagcagcgatcatcataccttcaatcatcttatgcgggtctccctccataatgcttcggtccataaatgcgcccgggtctccctcgtcaccgttacagacaacataacgttctttttcctgctgtttagccacctgtgaccatttataaccggtctggaagccgccgcccccgcgtccgcgcagattagattctgtaatttcctcaattacttcctccggcttcatattgaacagtgccttttcaagagcctggtatccgcctgtggaaatatactcctggatatgctctgcatcaatatgtccgcaatttttcagcacatttcttgtctgctttttataaaatggaatctcgtcctgtttctggtactcaatgccatcctgtttaaataaaagatgcctgatgatctctcctttttcaatcgttctgtggaatatctcatcgcagtcatccagctgtacctttgtatacagaattccctggggctctatcctcatcagaggtcccatctcacagaatccatggcatccgcttttcttaatgccaagttctccatccccatgtgcgatctcttccccaaaatgcacttccacatccggattttcatcgaccagctcacacattctcctgtaaatgtcaccggaaccgcctgccagacagcctgtccccgcacaaatcagcaccctgcatttactgttttctatctgtgctttcgaagcttcacgtaccagcccgagagcttctctgttctcaattctctccatatctctaagctcctctcaactcgcgaattaattcagctgctgcatccggcgtcattgccggatataccttatcattcactgtaagcaccggcgccagcccgcaggccccgagacaggaaaccgtttccagagtaaacagcatatcatctgttgttgctttttcgctggaaaggcccaattcgctgtagagacgctccaggatcggaatcgatttacgcacatgacaggctgttccatcacataccttgatgatgtattttccttttggctcaaaagaaaaattctcataaaatgttgccacactataagcctttgcctcattaatgcctagcttccctgccacatagctcaaaagctcaggcggcagataacggtattccgtctgaatgtcctgaataataggaatcagtgatgcctgttccgccccatgtgacgctatgatttcatctgccttgtcatagtaggtctgatctaacatgagatacctccttaaactgcgtttataaagctttcaaatccttataaactgtacttttgtatgatatagttaaaattttatcaatcactgtttattatatggtaaatgtggattttaggcaataggaaaatacactttttctcaataaaatcgggatttagtgacgagctttagccttggcgcggatgggggcgctccataaagggatagccgaaaacctcccggagaacatccatgtcctttcaaaaatgcgaccacgggcctaagaaattctaggcgggaaacagccctgaaaatggagcaccactgacacatcacgagaaatccgatgatttctcgcgctgggtcatctgatttttggatttggaatccaaaaatctctccattttccgggctgtttcccaccaagaatttctaaggtccgctttgagcgtttttgaaaggacatggatgttctccgggaggctttcggctatcccttcatggagctggcgcatccaaccggcaggaaaaggactcgttcctaaggtggggcctcaaacgggggcagcgtatggtattaaattggcgggacttctatgtccccagtaggtgtacataagcgatgggatacggttccagtatcaaaataattcaatacacatcttgaagatgaaaagatacgcatagccaatccacatccgctgccctggtccgggatcccacccggttggcgagctttccagccgattggatgagccagctttatgacagggaggccggggaggcggatggaattggctatgcgtaacatgcatcttgattaaatggattttaaggcttttatgtatgggagctttgggactgtttttgaagaaatctatttatttagtaacgattatcgtgtgtaactccatatgtttttttattaatgaaccatacaatcttttaaatccagtatatttacgggtaacaaggcgatctaacacttacacttatataaacgaatcaccaattctgttccatccgttgctaccgtacgagggcccctctggggaatgagctcttaactaccgtttggatgcaacagcgaatgacgaggtgagtccgggagctggcggggcaatgtctgctggtgaaaagtccataaagcgagcgattagaagctgttgaagaaaacggaacgggaagggagggcagaatttgccttaccaggcaaattctgatgccgcctgcggcgcgaatgcatcggcattcgggccaaatgcggcatgtacctcccttcccgttccgttttcttctacagcttcttcgcgaagtgtcaggacatttcaccagcagacattgccccgccagctcccggactcacctcgtcattcgcgtcctccgtccgtcaacgaggtctaaagctcgttaactatatcccgattgactttattgagttgatatgttatattaagtgtattagttgaattggtacacttcacacaccaaccatacaggaggttcgcatgataaacattgattatcaaagcaggacgcccatctatgagcagattgtcgaacgtttccagatgctcattctaaaaggcgtattaaaaccagacgaccagatgccctccgttcgcgcccttgcattacagctgtccattaatccgaatacgatccagaaggcctttgcccagctggaacagcagggatatatttatccggttaaggggcgggggaattttgtttccggcagcggtcagctggcaaagcagaaaaagctggcattttttgaagacttaaaaaaactgattttctatggcatggagatgggagtcacccgtgaagaatgcagtaaaataattgatcagctttatcaaaaggaggttctgcatgattgaattaaaaaatatagacaaaacatttcagaatatccatgcaatagatcatgttaccgcatcgatcagcgaggggatgatctttggactggtgggcagtaatggagcagggaaaagtactcttctgcgcctgatttcggggattctgaaaccagatgacggggctcttcttgtggacggacagcccgcctacgagaatcgggaggccaaagagaatatctgctttctctctgattctgcctatttttttcccaatgcgacacccgcggtcatgcgggattactacgcgatggtctatcctcagtttgacagcaaggcatttgacagtctcgcagaaaagctggacatcacacttaccaggaaactgaatacattttccaagggcatgaaaaagcaggtatccctgctgctcggcctatgcactgggacaaaatacctgctctgtgatgagacattcgatggactggatccggtcatgaggcaggcagtaaagagcctgtttgccgcagagctgatgcagcgggattttactccggtcattgcctcccataatctccgggagctggaggatatctgcgacagcatcgggctgctgcataaggggaagcttctgctcacccaggatctggatcagatgaaataccatgtccataagatccagtgcgtccttccagacgaagccagggaacagcagcttcttcaggaactgacggtcctgcagtacgagaaatccggttctctgatgctgatcacagcaaggggaacaaaggaagcgcttctcaactgtgttaattcgaaggctcctgtatttgcagaaatactgccattaactttagaagaaatctttatcagcgaaacggaggtagccggctatgacatcaaaaatctcatactttaaatttatagaatccgacatcaggcgccggggatggcttgccgccctgagcgcggtcctgctgttcctcatccttccggtttatacgcttctctcaatcgacagtataaagaaccagccatggtacaaagacggcagcggggatttccaaagttgggcttcaggaacatttcccgggttttttaacggttccacgaaccgctattttgctgtattgatcgtgatcctggctgttctttgtgcggtaaccggattctcctatctgcactccagagacaaacaggacttttatcattccatgccggtcaggcgtgtacagtggtttgcggtctcatactggggcggcctgattatttttctggtaccctatctgttgttcgcattgtccacactgctgattggtcaggcgcacggaatattgaacagggacattttgctgaccacctttacctctgtgatgggaggcatcctgggctttttgatctgttatcacaccagtattctggccatgttcctgacaggacgcattgttacaggagtacttgcttcatttgtcctgcttatatacgggaacattattatgtttcttatgggaggacttgcctctaaattctttcatacctggaccagcagctcccccgccattctacaagaggtcgcggaatatatgacaccagccaccctatatttgcggacattgcgtacgactaccctgcggccatcgtctccggctgtcctgatctgtgctgttctgtgtgctgtcatactgatcgcggctgctcttttaatctataaatattatccggcagaggcggctgaaaatgcactggccttttccagatcagctcctgtcattaagatcctgatcgcggtacccaccgcattatttatcggtttatttatcgattccttcagcgcaggcagcggctcacggtggattatttctttcagtatacttaccgtaattctgctctgtctgctgattgaattcatataccaccaagacatccggcagatactggcgggaaaagcgtcaatggccctatccctttgtgccgtggcggcaattctgtgtatcctgcagtttgacctgttcggatatgacacttatctgccaaaagaaaaaaagctcgccgaaatgtctgtatacaccgataatttttccgggtatttcgactatccggaaagctatgaaggagtccactatgaccagctgaatgccccggccgcagccatcaccgattacgagacactgtaccgtttgtcagaagaaggcatagagaacctgaagcaggggatcacaccccaattcattaatctgggaaacagctcccaggatgctgtcgttgtcacaatgcgttttggactcacgaacgggaaaaatatttaccggcagtatgcagtagacaaaacagcacttttgaatgcaatgaaacaggcctgtgagagtgaatcataccgaaaagagctcttcccggtcttccatctgaaccaggaagacatcctgggtatttctatgcaggatatctattacaaggccgattcactgcccttaaacaggaaagaacaaaaccagcttatcaatgcctacaaagaagacgtcctgaacgcagatattgcagaactacagaacgaagccccattgggtgaacttatcgtagattttccagacaagtatgctgctgaacccgtaaccggaaaaagcgtgcataaaattcagttaggccagttttatgtctatcgttcctatacaaatacactgcgcctgctggaggaacacggatacaaattccgaaccgaaattagtcccgatgacgttgcactaatgacctactatccaaatgaaggcacagacgatgtatatactcaaaatgctggccttggttattcaaccatagaaaagcagaaatcatcctatgattattccttcggagacggaatccccgtcaccagtcctgaagaaatccagaaacttctggatcagatcagctatgacgaatgcagcggactacttggaaactataagactacaacaggatccgtagaaatcacccttaacggaaaggcttatcccaatacttatgcggtttatggagagtgaggggggtggcaaaagggccgctgcgtggaagtggagcagggctctcctggatacggtattagggcataagtgccgctaatcaaaatcggagccggcatgttgaacatcgcagacactcacgagaattctgatgaattctcgctgcgggtctgctttcttccaggccttgtgggcctggaagaagttcacatgctggctccgattttgatgaagcggcactaatgccctaaaagacgcatccaggagagccctgctccacttccacacagctggtcgcatcctgtcagaagttaccgtcacttcccgggtgggaacgcggacgggagaggcgaattgtgcttcactggtgataccaaagtctccccagcagtaatgcacatctcccatccgtaatccgcctcaccgtcagttgcccaaccgatgtcaagcttctaccgaccggttgcaccagccactccgcagacaggcgtccctccccctttacatcaaaaacctcatccagttgaagggggtcaggagttttatgcggttttcacggcttttacttattttctgccttgtgactccctccgggatgttgtatgtcccgtcaggcagtgcctgcacggaatcgtcttcgtagcttttcatgtatcctctaagctgctttgttacctctttgctgtctatcacaagcatcagctctgtatccaggtaggcacttctcatgtccatgttgaaggaacctacgattgccagatcgtctccgattgtgatgcttttcccgtgataggaaactccgccttcgtattcatggatttccagtccggtatctaaaagttttcctttatttttcctgtaatccgaggcgccgaacgggttcccgttgttggctacggagttggtcattaaaaggacattttcgttagcttcacagaccgattcaaactcctgatacatccagtcattgcagatgatgtatggcgtgtggatggcgatttcttcatcggtgtccttcatcaggctggtcaaggcataaaacagcgttggctctttggcgtatacgtgggtcggattgctcagaagggtaatcttcccagtctcaaaagtcatggactgataatctggtttctcttttaatgccggattgttttttatgatctcctggtatctggcttccagctcttctttggcacgggtaacgtctttggcacgcaccctccaggaggtggtgctgaacttcttacatacatccagatcccatacggaatcaaaataggattccagctgatgtatggaactttcatcatcgggatttcctgtgtaaaccaagacatctctgtcgtaattcttatatccgttgtcccccaggaaatagtcgtaggtgttccttccgcccagcatatataggtcatcatccacgatcagatatttatcatgaagacggcccatgctcttccatggcgtcagcaggttaatccggttataaatcctgacctctacatttttttccgatgagagcgcataaaaatattcatttccatccatctgctgaaatgcggaaaacccgtctacaagaaccttcacatccacgccccgcctggcagcatggatcagagcggcaatgacatctttaccgctctggtccgcatgaaaatcaaatgttgaaaggataatcctgttctctgcctgttccagcatcttcaaacgttcttccagtccgtccacattatcctctatgatacatgccctgtcactgcataccgtatctgagtagcagtccgctgcatcaaaagattttttgtattccctgcttacctttggctgccggatataagatatgattgtccccaaaaggacatacagaacaaataccagaatacccaagataaggtatctgattttaaaatgtttcctgtttcttctgccttccattgctgtttttcagcctgcggcggcataatggcctcatacacaggctgagtacttccctcctaataataatttactttgactttttttcccatcttactgactacggactccagctgctctatcagattcatccgcacactgaggtcaaaactcaattccgagttctggtgtgcctcattcacggcagtccccacgaagagattcagctctgtgcactcttcgatcaagatctttgcaagccgggatgcaccgttattggcatccagttcatcgaagaactccacgtcaaattcatccttcacataccgtttcagcaatttcagcgccttgcccagggtcagcacaccctctgtcaccagatccagcccttctatcgttgccatagggggcacgttgggatcattgtaatccactttggtgataatatctttcctgagaatccttgcggcaatattggcgcttgtcccgccgcatacgattttccggccttctttatgcataaattcatgcatcagtttttcatcgtcttccttgctctttggaggccctgtaaatatattcaccactctccgctcgatcaccctggccactgccaccgttgtgtcatcgcccggtttctggacatagaggtcatcgcatgcttggcttagaagggcagccagcctggaggccgacatcgtttttttcgtgcactgcagggtatactccgccatactctcccaggtccacccctgcaggttcagtatctcacccgcgccggcatagatcacgccgtcgctcatcagtacaaagcagtcattctgctggaccttaaaacggtattcgtggattttctttccctcaatcaccctttcctcgtagggatagtttacaattttcttgtcccggataaatacacaggccggattatcgtattccaccagataggcgtctccattgcggaagatctgcaggatactgaaagtcgcatatgctaccttcctcacctggcagatcggaagtgttttggcgattgtcgccacacaagattctatggccgcgccttcgaacagcattgtcctgagtatcttggatgtcagtgttgcgagaatgttagctttcacaccactccccattccgtccgcaagaatcacaatgtcggagtcttccgtctttaagatctccactttatcgccgcacagttcttcgtggtgcttattcaggctcttccatgccacgtctatacttacgctcatatcattcctccccttcattgaggatagaatcccgaagttttgtcagcgtcacctttgtctctgctgttgtctcaccgagcagacctgcaatctcctgggcaaccatcatctgcttctcaatgacctcctgcgccatcttaacggtctccacttttaggaaataatgctgctccttgatcttctcctccctggttacatcctgaaaagtcacaagcacggaatccaggttttcaatataaacgatcgtctcctccgcagtcattctgccgtgttccagctggatcttcttgtggatcacgggctccctggtgcgcagtgtctcctcaatatcctctgcctctatgaattcgaaaatgtaacgctgaacggcctcatccctgcccactccgagcagttcctgggcctttttattacattccctgatcttcatactgctgtctataataaaaatcatattcggcgtaacatccatcaccacattggacatagactccgcctgcgtcagcgcatacggcatgcacatggacagttctgccttgttctgataaacggcgatcgctttatccctgcaggtaggataaccacatgctccgcagttcaattcgtcctcctcggaatatttcccggtagacttcagaatatcccggatctcttcatccgtggggatacggtccgtcagatgattgtcctcaaatgcctttgccagttcctgcgtgctcatatctggcaggtccctggccgccttataagatacctcattttcaatctttactttcgccttcacataagacgtattccaccttgcggatgccgggcccttcgcgcatcccccttcacagacatttgcctcaataaagcagtgctccagttctccccgctgcagacactccagcatctccatgcagtttgccagcccgtccacatagactttatggtatgtatcggcctcctcctcggtcacaacggactgaattacgcctccgctgattggatacatacggttaacctttggatccgggttgcccatgggcttatcctcgcaagcatagatgtcgattcctgcctcatccagccagatcgccagttcttcaaaagtaagaattgcatcaatcgctccgaatactctttcatccccgattgcctcctgtttcttcgcaatacacggccctaaaaataccactttcacatcgtctccgtacagtttttttatataacgtccgtgtgctaccataggtgataccaccggcgccagcagatccacgcagtcaggataatacttttccaccagatcattaacactcggacagcaggtcgtaattatattgggcatcgtattttcccgaatgatttttttatactcattcgtcaccatggctgccccttcagccgtctccctgacctctgcaaacccaagtttcaaaagagcatccacaatctgtcccggccgtttaaattccagtactcccatataagacggagcaatcgaaataatcgttttaaacccctgcctcagataccccttcacccgatccatatcgctggcaaacgtctttgcattctgcggacagatctccatacaccggccgcagttaatacagtggtccttaagaatatgcgcctgctcatcccgtacggaaatcgccttcaccatacagtagcgcacacacttgtaacagtgcctgcatttcgcatccttaaaatcaatcactctcatgacttctaagctcctctcatctcaaaacatttctgaaaccattctaccactgatccctccaaatatccataaattttagtgaatgacgggaggaatgaacggatgggggaaggaggccgcctgtggaaggagggacttgtgccggggggcgggaaacttccttccacaggctgggtgcatccagacggttgaatgctgttcatggggagtttaacggggccggtggatccttttggatacgcgtaaagtcctcctgtagtcaattataacgcacccccttacgataccgtcccacccaggcccgcaccatccgcatctcccgccttaatctcccctccgagggggaacgctctttcctgccggccggatgcgcccagctaagtgaaaggtgagccggatccccctgtggggctgtgcatgccatttttgtacccttagagcgcgcgatagaatccgttagagaaaaaacagggaacctggagggcagaatttgttttaccaaaacaaattctgttgccgcctgtggctcaaaatcatcaagattttgggccaaatgcggcaagtccctccaggttccctgtttttttctcttacggattcttagcaagcgggcaggatacagaaatggcatgcacagccccacagggggatccggctcaccttttacttagcgtcccgtccactcgctaaaacgctccttagttaatacttctctttacatagcttgtatgcagtatatgatgtgccttttcacttcccggttctccaaggaactcctcatagagtttcttgatagacgggttgtcatgtgattttctgatagtttttgctttgtcattatcatacagtgcctttgcacggatagctctgacatcttcatagttgcgtacgtctgcatgtacctgaggctgtccgcctccgtttacacatccgcccgggcagcacatgatctcgataaagtgatagtctgcctcccctgcacgtactttatccataatctgctttgcgttggacagtccggatgctactgctactttcacatccattcctgccacattgtatgtagcctctttgattccttctgtaccgcggacctcgttgaactccaggcttgcaagttcttcgcctgtcagggtctcaactgcggtacgcagcgctgcttccataacgcctccggttgctccgaagataacgcccgcacctgtggactctcctaacggatcgtcgaatccttcgtccggcaggcttctgaagttgattccgactttgcggatcagacgggcaagttctcttgtggtgattgagatgtctacgtcaggtactcctgctgcatcctggtcgtcacggttgatctcgaacttcttcgccgtacacggcattacgctgacacatacgatgttcttcgggtctatgcccatcttctcggcataatatgtctttgcgatagcgccgaacatctgctgtggtgatttgcagctggacaggtgttccagctgatccggatagtaatgctcacagtatttgatccatcccggtgaacaggaggtcatcatcggaagcactccgccgttctgtacacgatcgaggaactcatgtgcctcctccatgatggtaaggtctgcactgaagtctgtatcgaatactccgtcgaatccgattcttctgagtgccgccgccatcttgccttccacgtctgttcccatcggatatccgaattcttctccaagggcagctcttacggaaggagccggctgaacgatgacatgtttgctctcatccgcaattgcagcgagcacgtcgtcgataaagtctttttcatataaagcaccagtcggacatgcggtgatacactggccgcaggatacacagcttgtttccgccaggcccatatcaaacggtgagccgataaatgatgcgaatcctctgttgtttggtccaattacgcctacggactgtactttttcacagacagctgtacatcttctgcagagaatacacttgttattgtcacggatcatatgaggtgcactgtcatccagctcaaactccggtgattctcctgcaaaataattttcatcttccacgcccagttcctgacagagctcctgaagctcgcactttccgcttctgacgcaggacagacattttttatcatgattggaaagaatcagttccagcgtacgctttctcgatgcaatcagttccggagtgttggtcaggacctccattccctcattgatcgggtgtacacatgctgcaaccagattccttgcgccttttacttctacgatgcacatacggcaggcgccgatctcgttgatttccttcaggaagcacagcgtcgggatcttgatccctgcgatatgtgccgcatccagaatcgtagagcctgccggtgcacagacatctatgccattaattttaatatttacattttccatagtctctatcctccattactctttgtaaatcgcaccgaaacggcatttctccatacaagcaccgcacttaacacatttttcagggttaatcatatgtggttcttttacgctgccaatgattgcatcagacggacaggttcttgcacataaggtacaccctttacatttatcagcatcaatcttgtagtggagcaggtctttacatactcctgccggacattttttgtctacgatatgtgcgatgtattcgtccctgaagtaatgaagcgtggaaagtaccgggttcggcgctgtctgccccaatgcgcacagggaattggatttcaagtggtagcacagttcttccagcttatccagatcttccatagtagcctggcccttcgtgatcttctccaggatctccagcatacgtcttgtgccgacacggcatggcgtacacttaccacaggattcgtctactgtaaattccaggaagaacttcgcgatatctaccatacagttgtcttcatccataacgatcagaccgccggatcccatcatggagccgatctcgatcaggttatcatagtcgatcggcacatcaaagtgctcggccggaatacagccgccggatggtccgcctgtctgggctgctttgaacttcttgccgttcggcacaccgccgccaatctcttctacgatctcacggagcgtggttcccattggaatctccacaagaccagtattgttaatcttaccgccgagagcgaatacttttgtacccttagacttttccgtacccatggatgcaaaccattccgggccgttcacgataatctgcgggatgttcgcatacgtctcaacattattcaatatggtcggcttctcgaacaaacctttcagcgccgggaatggcggacgaggtcttggctcccctctgttgccctcgatagaagtcataagagccgtttcctcaccgcagacaaaagcgcctgcgccaagtctcaattcaatatcaaaatcgaagccgctgtcgaaaatattttttcctagcaggccgtattctctcgcctgtccgatcgcgatttcgaggcgttttactgcgattgggtactcagcacgcacataaatgtaaccctgtgaagcaccgatcgcatagcctgcgattgtcatagcctccagaactacgtgtgggtcgccttccagtacagaacggtccatgaatgcacccggatctccctcgtcggcattacagcagacatacttctgatccgcgtcatttgccgccgcaaatttccacttcaaacccgtcgggaaaccggcgcctccgcgtcctctaaggccgctgtccaacaggatctggatgacatcttccggtgtcttttccgtcagtacggtacccagggcctcatatcctcccgtacctatgtattcttcgatatcctccggattaataacaccgcagtttctcaaagcgactctcttctgtttcttgtaaaagtttgtctcattcagaggaagaatcttgtctgtctttgttgtctcatcataaagaagacgggtaactacccttccctttaacagatgttcggatacaatctccggaatatcgtcttcctgtaccatggaatagaaagatccttccggatatacaatcatgatcggtcccagtgcacacagtccgaagcagccggttttaacaacaccgacttcatcagccaggccctgggctttgatctctttctcaagtttttctataattctcgggcttccggaggaagtacagcctgttccaccacaaaccaaaacgtgcgaacgatacataatcatcagcctcctttattttttctcaacactcttctgtactgcacccaatgtatactttgttacgacctggccgtccagaagatgcattcttaatacttccaatgccttttccggattcatctttacatatgtaactttctccttgcctggttccatgacttctacgatcggctcgtactggcagagtccaatgcatcctgtctgtgttacgttaatattgttaaggccctgctcctgaacagcatcggaaagagctgtcagcactggtcttgcgccgcttgcgattccgcaggtagccatgccgaccaccactctgatctggtcttcgctctctgcgcggacgccgactttaccctgcattttttctctaattgcgcgtaattcttcgagagatttcatatatttcctccattcttattttcaaaatcatctatatatccgctccctgatctgcctcagccttatttgactcgagaaattccttgataaatccggaaacctccagacttgagaaagaaatatcttcccccagaatctctctgatctcacgagtatccagaacaaactcactgtcattataccggtaagtatagatgaatcgaatctgttcattgaaaacaaccagtgtatgtatggtagaactaatatccccgagcggcattctgtctatatgtgataatccaaaaacagcggttaccactgttccctttcctaattccgacataatggagaagctccctcctgtactctctgcagcctgtttgaaaaaaggcactcccaaacctactcttctcgtagtcctagtcgtgtaaaatgggtcctgcaccttttctacctgttctgcagacataccgcatccgtcatccttgattacaacggtgagcgtgtcctcctctgtctgcacagaaacccctatttcaataagtgatgctcctgcacgtacagaattttcagcaacgtccaatatgttcagagatatttccggcatcataggcttattcgtattttgctaaaatgtcgtcaatatcatccaccgtcagacggccatatacttcgtcattgaccatcaaaaccggagccagtccacaggcgcctacacaacggcatgcatccagtgaaaacttgccgtcaggcgtacattccccgccaacaatgccaagtttttccatgagcgcattgtaaatatccccggagcctttgacataacaggcagttccgagacagacggaaatctgatattttcctttcgggtttaatgtaaactgggaatagaatgtaacaactccgtatatcttttccagagggatcccggtttcgttagaaatgattgtctgtacctctattggaaggtatccatagatatcctgggctttttgaagaattggcatcaaggcgcctttttcatccttcagctcagctatcacttttaataaagattcttcttgttcctttgttcctgtaaacggaacggtttgtttcttcgcgagcatcgcttaacctccattcttttctttgggtttatacccatattataataccatgagatatgacaaaattccagaactatttacgttactttttgttcatatttgccgataattattctcattattactaatattcacgaaatcgggatttagtcggcaagctttagacttgtcgacggacggggacgcttcatgacagggaggccggggaagcgctggggctgtatatgccgttgcgatatgcacccatgctgctaagtgcttctagaacagccgatgccggatagacgggtacgctgaacacatcacgggaaatctgatgatttcccgcgctgggttcagcaaaaacttgatttggagatcaagtttttccccgcctatccggcatcggctgttcaagaatcactaagcgcactccagcatatcgcaacggcatatacagccccagcgcctccccggcctccctgtcataaagctggctcatccaatcggcaggaaagctcgccaaccgggtgggatcccggaccagggcagcggatgtggattggctatgcgtatcttttcatcttcaagatgtgttgaattattttgatactggaaccgtatcccattgcttatgtacacctactggggacataaaagtcccgccaattcaataccatacgctgcccccgcttgaggcctctccttagaaacgagctttttcctgccggttggatgcgccagctccatgaagggatagctgaaagcctcacggagaacatccatgtcctttcaaaaacgctcaaagcggaccttagaaattcttggtgggaaacaacccggaaaatggagagatttttggattccgaatccaaaaatcagctgacccagcgcgagaaatcatcggatttctcgtgatgtgtcagtggtgctccattttcagggctgtttcccgcctagaatttcttaggtccgcggccgcgtttttgaaaggacatagatgttctccgggaggttttcggctatccctttatggagcgtccccatccgcgccgagactaaagcccgtcgctaaatcccgattgctttttataggtacaaatgctatactaaacccatgattttacctgatatcttcttgggttaatactttattttcagaatttaggagggcttatgacaataggggaaatgaagaaattgctggatgccgacattctgttcggcgaagaattattggatttggatgcagaattcgttttttcatctgatatgatgagcgatgtccttgcctttgccgatcagtgctctgtcctgattaccggactgtgcaatccgcaggtggtcagaacggcggagatgctggacattgcctgtattgtatttgtacgcggcaagatgccggatgagaatatcattgcactggcccgcggcaagggaatggctattctggccaccaagcattttatgtttacaacatgtgggatcctgtacgaacacggactacggggaggtgcctgaatggatgaattattgacatttacttatacgatctccggggatgattttacccgtgccggggaggccagcagcgccattaaaaacaaactgaagatgctgggagtgaatgcttccgctatccgcaaggtcgccatcgccatgtatgagggtgagatcaacatggtgattcatgccaatggcggagaaatcaccgttacaatctcggatactgagatcacaatggtccttgccgatgtggggcctggtatcgaggacatctccaaggcaatgcaggaggggtactctactgcgccggaggaagtgcgttctctcggttttggtgccggcatgggacttccgaatatgaagaaatattcggatgattttcacatagaatctgtgcccggaaagggcactactgttaccatgaaggtatttatctaaccgcacagccggatttatgaatcactgtaacgaaaggagctgtcatggacaaatttatgcggtctgtccgactcaaggaagacctctgccagggctgtattaattgtatcaagtattgcccgacccaggcaattcgtgtacataatgggaaagcccatattatcgataagttctgcatagactgcggcaggtgtatccgttactgcccgcaccatgcaaagataccaatatatgattccttaaatgttttgaacgattacaaatataccgttgcactgcccgcgccgtcactctattctcagttcaacaacctgactaatgtggacattatactgaacgccctgcttaaactggggtttgacgacgtatatgaggtcagtgcggcggcggagctggtctccgaagcttccagggagtatatgaaggaacatgaagacgaagggccgttcatcagttccgcctgtccgtccgtggtcaggctgatccgggtgaagttcccctccctgctctccaagctgcttccgatcaaaccgccagtagaggttgccgccgagatagccagggcgcgtgccatagagaaaacggggctgccttccgaggatatcgggatcatctttatctccccgtgcccctccaaggtttcttattctaaagcgcctctaggaatcgacaagagcaacattgataaagtggttgccatcaaggatgtctatccgctgctgctcccgcatatgagccgagacgagtcacagctggagccgctctccaattccggcaggatcgggcttggctggggcaatgccggcggcgaagtgggcggtcttctgatcgacagctatctggcggccgatggtatcgtcaatatccttcgagttctggaagagattgaggatgagaggattcacggtctgaagtttatcgaactcagtgcctgcaacggcggttgtgttggcggcaccctgaccgtggaaaacgcttatgtggcaactaccaagacgaaacgcctgctgcgctatcagcccgtctccaaaagccatctctccagccatcctgagctgaaaagcgtacactgggatgacgatgtggagtatgaaccggtcttccgtcttggcaacagtttcaaggaaagcctggaaatgatgagcacggtggaagaactgaccaagaagttcccggggctggactgcggttcctgcggggcgcccacctgccagactttggcagaagatatcgtaagaggagctgcaaccagcaatgactgtatctacgtactgagagaacatatttccagtctctcaaaagagatcgattttctttccaaaacatccaatttgacctgtaactctgatgatgacaacgccaagctgcttcatgagtacatacataagctcacggcagaactggatgcattcggagttccgcagaggcataaaaataagagggaggaataaagtatgaaactacaggctgtattagagatacccggatgtaaggtgctggtaaaaggggatccgaagcgggaactgtccaaagtattctgctgcgacctgctcagcattgctatgagtaaggccccggcagacggtgtctgggttacggtaatggggaataagaatacactggcggttgcctctctgacggagaccgcctgcatcatcctggcggagggtgttggactggacgaagggacactaaaacaggcagaaagcgaaggcattgccgtcctgaccacggaacttccggtttttgacatggctctggaagtttatgaagcaggattatcatgattccgttatattatgacctgcatctccactcctgcctctccccctgtggagatgatgacatgactcctgccaatattgcaggtatggcttccatcaagggcctggacgttatcgccctcacggatcacaacagctgtaaaaactgccccgcagccatgttgcaaggcagagaatacggtgtcattgtcattcccggaatggagctgtgcaccgttgaggaagttcacgtcatctgcctctttcccgcactggagaatgcccttgcattcgacggatatgtgtatgaacatatgcttcccattaagaatagggaagcgatattcggcaaacagcagatcatggacgagaacgacaaagtaacgggtacggtggagaatctgctgattaatgccacggacattacgttcgacgatgctttttctctgactgcgtcctatggcggcatcgcctatccggcccatgtggataagagttcaacgagtgtcctctccaacctgggattcgtcccgccagacagtacctttacctgtgcggagttccatgacctgaaaaacctgcacagaatacaaaaagagcatccgtacttcttacaatgcaatatcgtaagcagttcagatgcccactatctcggggatatccgggaaccggaatatcagattttttcggaatcgaaggagattcctgacatactaaatgcgcttcagacaaaggcgtaggaaacggatgcaaggaatacgggcagattggctctattccttgaaccggtatcctacgcctacttctgtcactataaaccggggttctgcaggattcttctcaatctttctgcgcagcgtggccatgaatacccggagtgtaccggcctcgacgccttcaccatacccccagatcttttttaatatatagttgtgggtcagtacttttccgcggtttgaaataagcagcgtcaggatcttatactcgataggagtgaggtgtatctcctctccgtccacctggacacttcgtttcgtatagtctacggtcagataatcctgatgaaacatttcctgagcgctgtcaggcgctatcttctccatcttacgcatggcaaccctgattctcgccatcagttctcccatataaaatggtttcgtaacataatcatcggcccctgcatccagtgcctgtatcttttcctgctcttcctgccttgcagatacgacaataatcggagtgttggacaactccctgacatgcttaaccacctccaggccttccccatccggaagccccagatccagcaggatcatatccggctggtttgcgtagaaaaggctgattgcctcctttaccgacttcgcgacataatagccgtatccctcatcttttaatgtcatactcatgaaatttacaatatatttgtcatcttcaacaattaaaattgtctttttctcgttcatctataccacccgttcatgattcgttactattttctcgcggcctgttaacaggttcccttattctgcaattcttgcttccagccagaaggtaaatctggcgccgccctctctgcggttttctgcccatatcctgccgccgtgggcttccaccacctccttgcagattgcaaggcccaggccgattcctcgttttctgtctgtgcttttatccgaaagtgatacgaattcatcgaagatcttttccttcatctcctctgcgattccatcgccatcatctttcacgacaaagtaaaccctgtttttccggtaggaaacatccagggaaatgcttcccccgtcctgcgtatgcttcaccgcattgtccagaagattcaccaggacctgcatgatcatcttcccgtccatatccgctacaaccacacggtcaggcagggacactctgaaatcccttctgcttttcaggccgatcacatgcttctgcacctcatagacaatatcgtcgatgacctcctggtgtttttcgatgaactgctgtccactctcgatccgggtcatgctcagtacattttccatcatcttcatcagccacatagattgttctataacatcccgcaaaagttcgtcccgtgtctgtctgtccatagtctggttctcgatcatcaggctgcagtcacccataatccctgtcaggggtgtccgaaagtcatgagaaatactgcgcagcatactgctcttcatatgttcccgctgcacctccagtttggtctgctcctgttccgcatagatcagttcgcggtccagcgcgattccaatctggttggccgccgttttcaccagcatctccgcttccgccgccaatccctgtttgtggttgaacacttttaaagtccccagctgtctggccataccgatgatcgggaacatcaggtagtccttggaagtgtactcattgccagacccggcgggaattgtctccccttccagctctacaatactttcatatcccgtgtgctcataaatatagtggattcccagctggataatattatctttgccggttacattgatgaacttttcggacatctcatagagtctcagcgccgtctcctcactgccctgggcaattaccagctgtttctggaagcgggccgtcaggctggaggatatgcaggctgtaatcagaaaaaagcccatcagcgccacatcattcggattcataatcgcgaaggtgtgtaccggaatcgtaaaaaaatagttgaacatcataacgcttacaatagcgcctatgatgccgtactcatacccttttgtaaatacactgatcaaaagcacagccaccataaataccatcagcccgttttccttttccacaccgaactgattaagcaaaaggcagaccagactggcagacaatacgatcagtattgtccgcagtgcataaataagctttatattttttgcaagattcctgatcgcctttcccattccgtccatggctgcctccttgttcccgtgcccaaccgcagggtgtgagcaataacttcttctggattactggctcactgattccgtactatcataacactttagcggatatttgccaagattctgtcgatgtcctttttcagccccaccaccattagatgatcctctcttttcagaatccgctccgcatgaggaagcagctgcagatgtccgtccttcttgatacccaaaatactgacgtggtatttagagcgtatagccagctggcggatgctcttccctacccactcctcgaccggtggaatctcaaatatggaatacccctccgtcagctcgatatagtcaaatacatggttggcgctgtgttttacagccagccgttctgcaatatcccgatccgggtaaatgacttcgtccgctccgttacgcaggaggaactttgcgtgaatatctctgttggccttgctaacgacatattttgcccccatttccttgatcaggctggttatctccaggctgctctggaaattagagccaatacatacaaaacagatatcaaaattcccgattccaaggctcctcagcacatcctcatttgtacagtctcccacctttgccatcgtggcgtaagggagaaggtcctgcatgcattcctcatttctgtcaacaatcatcacttcattgcccagctgagacatattaacacacaaatgatgacccagcctgcccagtccaataatcaatactgatttcataatattcacctctgcctatcctatcattatcttttctaccggcgccttcacgggcgcctctattttgtgccctctaagagaaagggcaaatgtcatgctgccgattcttccgcagtacatcaggaaaatcaacaccagcttagagacagtctccatgtcccttgtaataccggtggacattcccactgttccaatagccgacaccacctcgaatgcaacatccgtcattgccgctggctgtacagttacaataaccagaaccgccaggatcactgcgaacaaattgatgcacaataccgcactggctttcctgatggaatcctcatccagccgtcttcccaggatattacagtgcatttccttccgcagattggcgtgtacataaattaggagtaccacaaatgtggttgtcttaacgcctcccgccgttgaccccgggctccctcctataaacatcaggatcgtagtcagaagcttgctgctgtcggtaagcgcagccgtatccactgtattgaacccggccgttcttgcggtcactgatccgaacagtgaacataacacctgatccccaaaaggcatgccggcaatggtattatttttttcaaagaaaaagagcagcgccgctcctccgaaaataagtattgctgttgatataagtacaattttagtgtgcagccggtatttacggaactttagcttatttaccgaaatgtcattccagacaaaaaaaccgattcctccaatgacaatcagactcataatcaccagattcacaacagggtcattataatatttagtaaaggaagagtatgccccgctctcccccatcagatcaaaaccggcgttacagaaagcggatatggaatgaaagactccaaagtataccgctttccccaggctcatctcccggctgaatctgaccgccaggatcagagcccccattccttcaaatatcgcagttccgacaataatctttttagccagccgtacaattccgcccacctgcataatattgacgctctcctggagcgtccctcttgtccagaggccaatcttcctccgcaggagaattgcgaagcatacgccgatggtcataaatcccagaccgccaatctgtatgatacacagaataacacactgtccgaatgtggaccagtactgaaaagtatccgcgattaccagtccggtcacgcatgcagcagaggtagaggtaaacagcgcatccgtaaagggggtgtatacccctgccttcgttgatacaggcagcatcaggagccctgcccccagaaaaatgataatacagtaccccaagacaatcatctgcgtctgggtcagtcgttttgtaaacagtttcatgccgcaccaacctcattttccattgcaagcagctccagccgctgcagcagttcttctttttctgtaaatacattgatgtgtgactgcctgtaaagcttcatgttgcttttctcattacatatgctgaacatctgcacgccggggtacattttatggaacagattgcataccgacaggttatcaatatcggatcctgagactgcggccagatagtttaccttcttccagttcttgtcaatataaatgctttccagataaatcggacggatacctgctttttcaaaccatcctgcaattttttcctcctcgctgctcttaccgaatatgactgcatattctttcttcctgtctttcttctggagtttcttttcctcatccatgaaattatcaatgcccctcatcaagtagaggccgtacagcattcccgctgttactatgattcctaaaataagattcgtcaacataactatcaccctcttttcttatctctatcatagtacttggcgcgtttaggcggtgataaaattaaattgaattgtattaagattgtgtttaggaaatcgggaaatagcgatgatctttagtttcggtgcggatggggtatgccaggcggtagtaaagaactcgtccccagagtgggtgcccgagacgggggaggcggatcgaattgactatgcatatcatgcatcttgattaaatggattttaaggcttttatgtatgggggctttgggactgttttgatgaaataatttttatttcctcatattagcggacatgaagtcccccccgtcaattctcctgctgtgggctgcgggtatttgaaagggcggggattcttcgcagctatttgtctccgtaatgtcctttgcaatgcgcgatatagatacggccattttccatatgatagaccagccggtctttatcgttgatgcggcggctgtattcgccttgtaggtcgccggttaagggttcaggctttccgatgccctccatacagccgttgcgctcaatgtcttttatgagctgattgatacgctttattgtttttctgtcctgggcctgccaatagatatagtctttccaggcatcgtctgaccagattttttcactcatcctctacctcgatcagttcgtgcgccgttcctttaccttctcggagttccttgacggatttttttacataggccatatttgattctgaaaaaaatggatcggtggcctgtgtgatttcaaatggaattcggttttcgcgtaaaactgcttttacaaaaagattgatggctgtggaggtatttaggccgacattagagcaaaaggcgtcaaagctggctttatctttttcgtctactcgtgcagttatagttgattgtgccatgatatcatctccttcctgtattctatctgtctttattatagcattattgtatgcgtattacaagctattgtaatacgttaggtataaaatttgtttgggaatatttataaaaatttgagcagtatcttttttggagccgtggtgtagcggaacgtataatttatcgctctactcccccatagaaatgcctgtggcgcttaccaagcgctggttagttattttaaattgggagtgtgcatacgcttcttgaatataggcaaaaaaaatacggcgcacaccctcttgaatggatgcgcgctgtattggctaccgcaaaattgtattgaagtttgtcggtaaataaaaaagcagataacgggaatcgaacccgcctctccagcttgggaagctggcattctaccaatgaactatatctgcatcacaaaaaatattatacatcgtttgattttcaaatgcaagtaatttttccagtttaataaatattttcgttgctactcaactcccctgtttatagtaacatattttcaaatatatcccattattttttttgcctttagtgttatatcagcttctatttcttttaaaccaacatggcctatgcaaccggcaaaattgtcttttcttccttttcctgccccatactctactcgtcaaactccaataccgccacatggaaccgcggagtctcttttatctccacgacagtgcctgttcttgtcttcaatcgttctgcatttttgaagtttccgctcatgccgagcgcgtgttcgattgtataaaaataagatgtcggaagctttccctctgttacctcgagggtctggcctatacgaaatgcctctatgttttcaatcgtgaattccatggttctcattacttatccttctttctataactccatttttttctccagctcttcccggaacttcttcacctttcccggatcgtttccaccggaattgatcccgattacaatttcatctttctggatcaccgacgggaaataaaaatcgcagagactcctgtcgtctgctacgctgagcagtattcttctgccgcaggaacgctcaagttctctgcattccctggcaatactgtgattcagcacactgtcattggttgcagcaaggaccaagtcggcgccactgatatcgccggctttgtacatgcggcgttcgcagcggatcttctgctctgccgcaaggttttccatagcttcagataattctggcgctatgactgttatgtccgacgcaaaacgggtgagcactgcagcccgcctggccgcaatttttcccccgcctgcaatgatgatctttttctctgacagatccacaaataatgggaaatatgctttttccatttttacccccacctgcacgctgcggtgcgcacttatttcaattattgaatataccgttttattctaaccaactgtcagtccagcatatacagcagtgcattgcatatacatgctgcgatgttgcttccgccctttctgcccctggctacaatggacggagtttcctccagcgcaagtatcagttctttagactgcactacgttcacgaacccgaccggcactgcaatgatcagctccggattcagcctcttttcctgaaccatctcataaagatgtaccagcgcagtgggagcattgcctatggcaaaaatcagcttttcatcgagagctgcggctttttccatacttgccgtagctcgggtagtgccattctcctttgcagaccttgcaacatcctcatctgccataaagcagtagactttccccccatatttttccagtctctttttattgattcccgcttttcccatctgggtatctgtaacgatggatgccccatttttcaaggcttccagcgcacgatccacggcgccgtccgaaaataccagattctttgcgtaatcaaaatctgcacttgtatggatacatcgctttacaatctgttccgttcccggaatcaagggtgtatctcccaactcttccgttataatttcaaaacttcttgcctcaatttctccgggcagtaccttttccagatttatatgattcatgcctgtttatctcctttcagcggaactccgatcccacatatgacccggtctactctggatgccagtgcagccagttccgtgcagatgcgtcccgttttttctctgtattctctttcaaatgcatcgacggggaccagaccgtatccgatctcccgtgacacaactaccagccccgggctgcgctctgcgatggaatgtaccagaccgtccagattgtccccttttttcattcttctttttatatactcttcaaaatggaaaataccgccgcaagtgtacagcgcctcctcagggcagtctgcaccgtccgcccattgtatgtttccataggtctgctctgcaaatttacgttttccctgaaaagctccgccaatcaccatttttaaggatacggaggacgtattcttctgctttttggttcctttctgcatgacattttcctcctgttccctgcgggccggattctgtccttttacaaagactggcatcccatacactacttccaccactccatctgctgttgctgccattccccggttaatctccgcaagcattttcttatacagtgccatctcgctggtatcctcagttgattccgaacaaatttcatttgtcactacaaccagatgacggcagcgattcttcaacatttcaattcctgcaagcacacttgccaccgcatcattaccggctcctccaggttcatacatctcgttcgccaccagattagacatgcattcaagcaggacacagggctttccctgacttttcaaagaatctgaagcatcttcatacagctgccctcctttttcggtcagcgcacccagccccgtatagcactctattgtggaaaatcctttgttcatgcgcatgtcacggtggcgccgaatcttgctcctggtttcctccccgtaaggaaccatcgtcgcgatatagagcaggctgcctgcggggtgatctgacccgggcacgtgataattccggcagatcaaatcttctgcaaaggccgactttccgctgccgctgcctcctgttactacataaaacatccccctccccctttcctgcactgtcttgtaaaagttcaggcagacctgaacttttacgatgtatcacttttctgctgtatgaactgtttatactttcttgcttcttcttatttctcaatatctgcataccggtattccaatgcccccgtagccggaatctgtgtcaccccggtgatctccgggcggataagattacagctcttcatggaaaacaacgggatgatatagaactcttctcctactgccagctgctctgcttcatgcatcagagacgcccgcttctgaggatctgtctccgtgtcggactgtgcaaccagactgtcatatctttcatcctgaatgccgctgcagttataggttccgttagaaagcagcatggacagatacgtatagggatccgcaaaatccgctgtccagttcattctgcacaggtcaaaattgcccgcacggcgttctgtatagtttacctgcaattcctgggcattgagttcaatatcaatgttcaggttctttttcagctgctctttgaaaacctgggccgtatcggaatccatttccagtgacggatagttataagtcagcgtcggaaatccctctccatccgggtacccggcctctgccagcagttgcctggcctcttccacattttcttcgaagggaggttctgcaccgtccacaaaatattcaccggtggttttatccttcatatactttgcgataaaattcacggtaggctctgtgtcttcgcccacgatctggcagagctcctcccggttaatggcgagattgatcgcctttctcacccgcacatcgtccagcggctttacattcaggttcgggtagatatacctggtggcaatcgtatcggtaatcaccagatcatcctttccatcatacagttccataacagaggactggagggacggggcaacgtctacctcgccggtctcatacgcatttgccattgactgcgtgtcatcgaagaaacggtaggtgattttatccagcttcacctgttctgcattccaatatttgggattcttttccaggacaaaatactgctccggcacatattctgtgagataaaacgggccgtttgatacgctggttgccggactcttgtcccacccgctgtccactgaatccgcatatttcgtgcaggacggcgtatagaccggaagccgcagcaaatccaaaaagtatacacagggcttctccagtgtaaagatcagggtattgtcatccggagtttccactcccaggctgtccacgtccgcttctccgttgtaaatggcttctgcattttttatagggaacaggtaattggcatatccattaccgcttttcggatccagagatctgactatcgtgttcagaaaatccgcagatgtcaccggggttccgtcagaccaggacgcttctttgcgcaggtggaaggtccagaccgtggaatcgtcgttgacctcgtaggattctgccgcccggtattcaatctcgccctgggcattataggtcagcagctcgtccagtgcggacacggaatatgccagataagtcagagcaatcatccccgccggatccagtcccccagtctcactgttcgtagccaccacgatttccttactttcttttgctttctcaggttcctccttgctgccacatccgctcagtacaaatgtggctagtaaagacacggacacaataacactcagtatttttttcatgcttttctccttatatttgtgaagtcatcttgtaatcaccgcttcttcttcccgtatattccaccgaatacaggaaacaggctaccttcctgtcaccaaaacagtacgtttttggccggcctgtatggcagcactccatcgcatatccgcagcgaggtgcaaacgggcagcctcctgcactctctgccttctgtcctggttctcctgctgccgccatcccccggcgcttcctggctgtccgcggatctggggtcagtatcgccgacagaagagctttcgtgtaaggatgccagggatcttcgtagatggattgtgtcgccccggattccacaatacttccggcgtacataacccctatcctctggctgattctttttaccacgttcaaatcatgggatataaacagataggaaacctgggtttctctctgaatcttttccagcagttccagtatctgttcctgaatcgaaacatccagcgccgaaaccggctcatcgcagacgatcagctcaggtcttagcatcaatgcccttgcgatcccgattcgctgacgctgtcccccggaaaaagcccgcggatattttcctgcgtcatccggattcagcccggccagttccatgatatccgctaccttttcttttctctcatccggaggatccgccgtgttcaaaagcagcggttcctccagtgtctcccggactgtcatccttggattcagcgacgcataaggatcttgaaacaccatctggatctggcggcacatcccctccagctcttttccccggtaaattaccttgccctccgaaggagcatgtaccccggttatcattttagcgaccgttgttttcccgcacccgctctctccgactaggccgtaggtctctcccttatcaatctcaaaggagacgtcgcgcacggcctctggctgattcccttttgcctgtcctccccctccggaataggatttcgtcacatgcttcagtgtgagcagcggctcggaggatatttttttctttgtcaaagcgctgaggccgttggccctctcaatgagcagacgtgtgtattcttcccggggatcataaaagatttcctctacggtaccctcctctaccatttttccgttcttcataaccagaacacggcggcacaccgatgcgattacgccaagatcatggctcaccagcagaaccgcggtctccgtctcctcggcaatccgggccagcagtttaagaatctgcccctgaaccgtcacatccagcgccgtggtaggctcatcggctatcagaagcttcggagcacatgccagtgctatggcgatagccgcccgttggcgcatcccccctgacatctcgaaaggatacttatccaggcactctctcggccgccgcagccctgccatatccagcagttcttcggctctttgcttcgcctgcgcacgggtacagcttttattgtgcgcgcgcaccgcttctgtgatctgccttccgatctttaccgtgggattcagataggacagcggatcctggaacaccatagcgatctggctgccgcggatctgctgcatctttttctcataggctttttgttcctgtttcctgggtctgccttcccggtaaggaggaggcgcgatctcttccccgttcaggagcattttttggcacatcacctctgcacgctcgggaagcagccccagaactgcctgcatagccgtactcttccccgagcccgactctccgacaatccccacgatctctcccgggccgatctcaaagctgagactgctcacggcctcgccatttgcatgtctgtcatgaaattgtacgctcaaatcctgtacactcaatacattcatttgcagttaaccttcctcttccaggcgggacgctctctcaagccctgccccgatcaaatttacagataatatcaaaatacacagcaccgcaatcggataaaacatctgggacggatagacctgcatctggctcctggcatcctgtattaatgtgcccaggctcgccaccggcgcagctatgcccacgcccacaaagctgaggaacgcctccgtaaatatcgccttcggtatctgaaacgtgatgttcacgatcaccggccctgccgcattcggcagcaaatgcttcctcagaactcttacggttccagctcccgccatcctggccgcaacacagaattcccgttctttcagccgcatgacctcgcctcggacaatccgggccaggtcaatccagccggatatgcagatgccgagcaggatactgcccacatttgctcccagaacaagcataataagtatgacatacaatagggaggggatggcgtcaatgatatctgcaagcctcatcatgagcatgtccgttttctgacctgcatatccggcgatgctcccgtagaggataccgattacaccgcagaacagggcgctgccagcccccacaagcaggctgattctggtgccgtaccacactctgacgaagagatccctgccgaatttgtctgtcccaaagagatgctgcagggacgaaccggcgttttgaatctccacattctgtgtttcataggaatagggtgacagcgcaggtaccagaagagccagcagaataagagcagccagcagaataccgcctgtcagcacatagggatttaacttttttttgaaacctgcaggagaattgtccggctgacagacacttaagggctgtctctggtaaatcgtctttttcatcggcaggccctccttacacgtggatccagccatgcacacagcagatccgtaagcagattgatgccgatcaccacgattcccataaatacggtcagacccatgatcagcgtgtaatcccggtttcctatggaattcacgaattcccgtcccagtcccggtatggtaaatatactctcaaccacaaagcttccggtcagcaaaaatgccgctgcaggaccgatataattcaacaccggaatccaggcgtttttcaatatatgggtaagcgccgtcctgcccggcttcaaacctttcgccctggccagcacgacatagtccttctgcatctcctcccggaatgtattctgcatcatccgggcaataaccgccgtcggatatactgccagcgagatcacaggcagtatataattctccgtgccggtcaggcctgcaatgggaaggagtttcagcttcaccccgaagaaaaacatcagaagcagggctatgacaaagttggggataccggttccaagtatggcccccagaaatattcctcctttcacggcctttctgtccgaagatgcctgccagatgccaagcagtgttccgaacaccacagccgccaggattgccagacctccaagggctgctgtcataggccaggcacggcggatcacttccacaacagtcactcccggcttcttataggagacacccaggtctccctgaagaagattgcccagatacagcctgtactgttccgtcatgggcttgtccagaccgtactcctcctccatggatttcagaacatcaccggacacatttccgctttgaaacgggcttcccggcatcaggcgggtcagaaaaaacgcggctgttaccagtacgaaaagagaaaggataccgataaatatccgtttgcctgtatatttcagcatttgaacttcctcctttcgtactgtgcgttactatgcacggcctatgggccgtgcatagtaacggcatcttgctcatttaaagtcgcctgtggcgaggagccagatgcccggctccatcactttattggctcggatgccgtgcagcgtggtgcacggccccgtgaatagtaactactgtgcttccgggtttacaactcttttgaagccaattcttctatcagcagatctgtcaggctgtctatggaagccttctcggaaacccggatctgcatgtggtattttgctgcctcggctgcggtctgttctccaatacagactgccagtaaactactgtagtccttaagcttcatggcatttacaaaaccgcggaccgtggacgcgcttgtgaatgtaactgcatcaatcccaccctcttcaaagaggccggtgattttctcccggatatgactgtgcgtcttataaaccgtctcataaagcgcaatatcttctgcctcaagtcctgcctcccttaacggcggaagcagttcctcggaaccaatcttagcccggactatagtcacacagcttcccggttctgccgcttctgccagcgccttccccagactggcagcacagtagacttccggcaccagatccgggaacaggccatatccctgaagcgccttttcggtagcgcttccaatcgcagcaagcttgatcgctgccggcctgccaaacaggctgcgcaaatctgttttcatttcagccagctgtccgaaaaagacctctaccccgatggggcttgtaaacacaagccattcttctttggcacgggttccgaacctttccagcgcctccttcagaaccggattgggggagagtgcctccgtcacgatcgagggcaattctatcacctgtgctcccagtccgcgcagccttgccgccagcctggagctgttctgccggggcctcgtgatgaggatctgcctgccccccagcacccggtcttccgcccaatggaaggtatctgccagaccgcagacttcgcccaccagaataatggccggggtgccgattcctgcttcttttgctgcttttggcagtcctgacacagtggagactacccgccgctgggcagcgagtgttcctttttccagtacggccgcaggcatattttcgttcatccccgcgtccataagaccttttaggatggtctccatggaagcaattcccatcagaaatacgagtgtccccccgagccccacgagggaaggataatcaattctgctggttccatcctttctcggatgtcctgtaatcacatggaaagaagaagtataatctctgtgggtaatcggaatccccgcataggcaggtactgctgccgcagaagtcacgccggggactacctcaaaaggaatcccgttttctttcagcagctccagctcttcgccgccccgcccgaatataaacgggtcgccgcctttcaaccgcagcacctttttccctttttgggcctcctccagcagaatttcattgatcccctcctgagggaccaggtggtgtccggaccgctttcccacatggatcagttccttttcatccggaatctggctcagaatctctgcgctgatcagcgcatcatatacgataacatccgcctcttccagcagctgtttcgccctcacggtcagaagtcccgcatcccccgggccggcgcctgccagccagacttttccgctcttttccatctcaatccctccgtctcatgtcttctgccagagctgcgccaagctgtctggcatccgccgtattaccaattcttgtctctgtccagtaagtatcatcctcttcgcggtaatacagacctgtcagtttcagttcgctgccatttgcctccgcgtgcgccgctaccggtgaagtgcagccgccatccagggctgctacaaattcgcgttccgcaagagcttcaaacctgctctttgcgctctccacgcaatccaggaaggaatggtcttcccctttcctgccctgaacggccagaattccctggccggctgcgggaaccatctcttctgtgctgaatatccgtccgatgacatgctccatgttcagacgtctcagcccagccgctgccaggatcgttccgtcatagccctcttcctccagcttgcggagacgggtctggacatttccccggatcccgcggaaagtacatcctggatacagtttaccaagctgcaggctgcgccttctgctggaagtcccaatgacgccgttttccggaaccccgctgcatcccggcctgcagatcagcgcatctcttggatctatccgtctgctgtatgcggcaatgggcagctcctctggtatctccatgggcatatccttcaggctgtgcacagagatatcaatacttccctctaagagtgctttatccagttctttcacaaataatcccttgccgccgatcagttccaggcttttatccaggattttatcacccgtcgtcttcatcgtaaccagttcgacctgtatctcaggatggttcttctgtatcagttctttcactatttccgcctgaatgacggccagccggctctcccggcttcctatccgaatgacagagctcatgatgtatggtttcctttctccaagatctcataaattgccttcatatccatattttcccgaataatatcagccagcttatcatactgttcttccttgtataccgccagatccaccgctttgacggccccggcatccagtcctttctgcttcagcagcacagctgcaaccgctccggccgcctccggccggtcaaaaacgccgtgcacataacagccgcacacgctcccggccgccgcaccgtccagcttaaccgcttttccctgaacgtcgtcttccaacgtaaggatcggctgttcatcccccataaaactggtagttcccatatggatttcatagccctcaatttttacgccgttcaattcttccagggcgccgctcagattccggaactgcccgctgaccctggttctcgtcttctgcggctcgaatacagttttcacgggaagcagccccatcccctttacagatccctgatgttccatgccctgcggatccacgatttcttccccgagcatctggtagccgccgcagatgccgaagaccagttttcccgctgctccatggcggatcactttagcctccagcccgttctggcgcatccacagcaggtcttcgatggtattcttgctgcccggcacgatcacggcgtccgggctgccgaattctcccgcagaggttacatatctcaccgaaacgccctctatgcattccaacgccaggaaatccgtaaaattcgagatacggggagtacggatcaccgcgatatccagtatccccacggttccctttttatcaaatcgttccgtcaggctgtcctcatcgtcaatgtccaggtaaaaatagggaatcaccccctgcaccggcacctttgtcctttcctccagcatatccaggccggggcgcagaatttccttgtccccccggaacttattgatcacggtgcctttgatccgatcccgctcctccttgtccagaagctccagtgttcccacgatctgtgcaaacacaccgcccctgtcaatatcccctacaagcagcaccggcgcatccaccagctttgccattcccatgtttacgatatcatcgtccttcaggttgatctccgccgggcttcccgcgccttcgatcacaatgatatcatattgttcctccagcttgtgatatgcctccaaaatagccggaatatactcttttttatggcggtagtactctgccgcagacatcacaccggttacctcaccgtttacaatcacctgggagcccgtgtcattggtcggtttcagaagaatcgggttcatctccacgcagggctctatccccgcagcttccgcctgcatgacctgtgctctgcccatctccaggccttcctttgtaatataggagttcagcgccatgttctgtgatttaaaaggggccgttttgtacccgtcctgccgaaagactctgcaaagccctcccaccagtatgctttttcctgcattagacattgttccctggatcataattacctttgccactgttctcccatcctttctgcatcccgtatttctttctgcccgcagacctcttccagcgcgcggatcagcaggcggttctcctccctgcctttcacggccaccctgtaatatccctgtttcaatccttcgtaattgctgcagtccctgatcagtatctttttttctttcagcagtgtaaataagtcataactgcttttcagaagcatataatttgctgaggacggaaaatacctgactcctattctttcaaattctttttccatcattttccgttcctcactcacaaaagctctggtagtttttacccgttcttcctccttcagagccgcaattcccgccgcctgggccggagccgacacgctccagggctgtctcacccgttccattttttccataagttcctcatccgaacagattccgtatcccagacgcagtcccggcatggcatgcatctttgtaaatgcgcggagcagaaagagcttgcggtacttccgtactttttcgggagcgaacaccagttcctgattatccagaaattcgtaaaagcattcatccagtatcatccggattcccagcctctcacatttttctgcaatcttttccagcagatccggctctatcatattgcctgttggattatccggtgcgcagagaaaaatcagatccacatcctctgtcagcatatcaagatactcctctccaagccggaaactctcttcctccctgagataataatatctgatcccgcagcccgacgcggcaagcgcctgcgcatattccgcaaaagaaggcgctgtcagcacggcctgtttcggcctttcggcggaaacgagagagaagatcagatccgcagccccgttcccgaataccagcctctccccggacactcccagctgctttgccagcgcctccctgagtgcccggcacctgctgtcaggataagccccgaccgaatccatcgcccggcatgctgcctccttcaccgccgcactcgggccgaagggattgatatttgcggaaaagtcggtcattcctctgtatgtataaatatccccgccatgtatgtaatccatgggaacctccttaaataatatatcgtttagaaccaaaacaggatcagcagaacctttactgcgcctgccagaagaaatgtaagaaccgcagtcccatagagcagtctgcccgctctcacaatatcctccgcctctacaggcctgagcgcatccccgatgtgttttttcttatacagctttccgaaataacatgcatcccctgccagctgtatttggagcgcccctgcacacacagcttctgtctgggcggaattcggacttgcatggttcatacggtccctccggtagatccgccaggcattctttccatccatccccagcatatatgcggccgccgtcatcagccaggcggactgccttgccgggatatagttcagcacatcatccagctttgcagcagtccttcccaggtacaaatatttttcatctttataaccgatcatagagtccatcgtgttgaccgctttatagaaaaacccaaggggcgcacccccgatcatcataaagatcaaaggagctgtcactccgtcggaagtattctccgctacggtctccactgctgccttaactacgcccgcctcatccagctgatccgtatctcttcccacgatcatggacacggctttgcgggctcccggaaggtctccttttttgatctcatcgtacaccttccggctctcctgctttaaggacttcgccgccagaagctgatagcaccagaaactctccaatacgaaccgcagcgccggatgaatccgccctgcggcatacaacaggatgcatggtacgataacggataccgcaatcacaaggatacagatcactgttcctgcccagagcaattttttttcatccctcccgcacaggacgcgcgcctttttttccagccatgcaatcaaggcccctatcagcctcaccggatgataaagccacaccggatctccgcatataaaatctaatataaatcctgtcccacaggcgatcagtgacatcataacttctcaatctccccgcttactctgctgccttggcgccaggcttcttcatccagcgccacccggtatcctccgccgttttccagctgccagtgatagaactcccttttctctttatcaatacaggacagcaccgccataatcgtgccgccgtgtacgaccatggccgcctttttcacctcttccgagatcagccggtctacgcattcgtaaaatccctccacacagcgctgtctgaacagcttcgggtcctccccctcagggaagggtatagttccattggaatccagccattcctgataagccggaatctcttttagttcttcatagcgtttcatttcaaaaagcccaaagtcacattcccgcattttttcacagagaacaggggttttatccggaaatatacaggctgccgtctggatgcatcttttcatggggcttatgattacctgctccacatcccggcatgagtcctgcctttcccgaatgagctgctctcttcccttcaggtctgccagaggctcgtcggttcttcctatatatcttttctcaacatttcccggtgtctggaaatgccggatcatgattatctccatccaatccctcctgccagaacaatcacggtaagcatggccagttcacagagctgcaggaagtaccccgccagatctccggttatgcctccgaattgttttttacatgtatgcctgtagtatagaaataccaataccgctgccgccagagctgccgttcccagcgcagggctcaggatcagcatcagcgcgcccgccgcaagaaaacacaggcttgtcgctgctcgcacggtctttttctgggccccatcctggaatgtcctcgccagcccgctgttgcgcgccgccggaaaggttacgacagagaatccgctcatagagcgggaaatcacgtatccgcatgcgatcaccggcagcatatctttcgttacttcactccatatcgcggcattccataggaaataacagcacatgccgagaatcgcaaacgccccggaattagagtccttcagaatggcaagctttttctccctgtcaccgtaggagctgagcgcatccatggtgtccataaaaccgtccatgtggatgcctccggtcaccagaacgggcagcagcgtcattgccgccgcaaacagaaacgtacctgcgcccaagtccagcaggagtccgcccactatgacttccaaaacgccaagcacgcccccgactaccgggaaaaagcacatcgcatacttcatatttttttcgttccagtccacccgcggcatcggaattttagaatacatggaaaatgcaatcgcgcaggatttcagcagatacataaggttcctcttttctttctcagattactcccgataacatcactgccctgtcttagagtgtgtctccggatttactttattttagtacttcgtatttctcaatattcgtttcctcaaaggtgctcatctgcagatatacctgcagccccatctccaggagcggaaatactgccaccgcgccgcttccttccccaaggcacatgtcacaggtcagaaatggcgccagcccgagcgcgtccaacagcatctgtccggccggttccttagatacgtgggagggcatcatataatccagcgatgcaggcacaagcctggctgcgcacagtgctgcaaccgcagagataaagccgtcgatcacaaccgggatatgataaagtgcgccgcccagatagactccggcaagcccggcaatatccaggcctccgacttttgccatcacatccatggcatcgtccctgtccggcctgtgtctgcagatggcctctttgatcacactgattttgcgttccaggccttcactggtcagcccggcccctttaccagtcacctcttccaccggcttgtccagaaggactgctgccacagcgctgcttgtcgtcgtattgccgattcccatttcaccggtagccagaatgtcatatccctgctctttgagttctccagcgatccggatccctgtcaccacggcctgccaggcttcctctctgctcatggccggttcctgtgccagatttttcgtgccgcaggccacttttctgtccgccctggtaacagaaggcacatctgtcaccatcccgatatccacaggaaacagatccgcgcccgcaacctcactcatgattgcaacgcttgccgcttttttcgtaaaattatccgcaacgattgctgtgacttcctggcccgtctgtgtgaccccctccgccacaacaccgttgtccgcacacatgataaccaggcccctctttttcagttcatactgggcgcttcttttcatccccgcaatccgaatgacagcatcctccagcttccccaggctgaacaggggctttgccacggacatccaccgcctcctggcagcctcagcgctggctttatcggccggctcgatctgcgccctcaatttttccagtgtcatatcatctttttctgctgtcatttctcaaggtctccttttcctacattcttctataaaacggccggcaaatgcctggttagaataaaagtggatatggggaaatcctgcgaacaggctaccttccatgtgaatgcattcccactttctttttcgatcggtcttgacggcaaggcagtctgttccattgtctgtactgtcccaataatgaaactcgtgtccccttatctttttccctttatccagatatagccccgctttcatggcttccagctctatatagccaaagcgtaccaggcgctttgtccggaatgcttttcctggtatcactcccgccattctgcgtgcagtgcctttgtcgtcctccatctcttcatgcagatacagaaatccaccgcactctgcaaggcaggggagcccgtccgcaagcgcatgttttaccgaactgcgcatggacgcattcttttccagctgttctgtataaagctcgggatagccgcctcccaggatcaggccctggatgtcatccggaagagagcggtctcttaaagggctgaactgaaccagctcacagcccgccttttccagaaacgccagattatctttatagtaaaagcaaaatgcttcatctctggcaaccgcaatcctgaccggggcgccgtcagcatcccgttctttatccgctgtttgcttcccccgggcggcttttgtgtctgcgggatgaaacgcctctttgtcactgtaccagacttccggcattcccccggaaaactgtgcggcgatcttcagcagacaatccagttccacagtctctgacaggatctttccggcctcctccagctgctctctgatctccccgatctcctgcggcgtcaccagtcccaagtgcctgctctccaaaccaaacaccggattttccggcacatagcctatcacagggatcgggtaccccgcctgcgccaggccggtttcgatcatccgtttcatcttcggatagagcatcccggatacacgatttaacaggatcccgctgatattactgtccttgcggaatccaaggatcccctgaatgacaggaagaacagaaagtgccatacccctgcacgggacgacgagaatgaccggcgccttcagggtccgtgccacatcgtaggaactgcctctttcactgtccagcgccattccgtcataatatcccatgaccccttctatgaccgttatgtccgcctgttttgcatgctcatggaataaggcccgcataacctgcggctcacagaaaaataaatccaggttctcggattcaatccccagaacctcccggtggaacatggggtcaatataatccggtccgcatttgcatgcggacaccttcatccccttctgtttcagggcagacatcagtccgcaggaaatcacggtcttaccgctcccgctggaagcggcggctatcataaaacttggaatctgcatacctgctcttctcctttttcctctccgttactatccttactgccgttttccggttactatgcgcgatccataggccgtgaatagtaacgttttccggcagaaataatgtatacgggattctgtcccgtcatcatatggtaagcccccagtttccgggatttggctgcggacagctgcacgatctccgcatcgggcaggagcccctcctccagcgcttccatggcctcttttaccgtctccagagagatcgcattcagcacaatccgtacatcagggttcttctccagcacaagtcttaagatgtcttttagattaccggaactgcctccgataaatacatgggtcggcggctccagcgcctcgattgcttccggcgccgttccctccacaatctgcacatggtcacagcagaacttcctgcggttttggccgatgagttctacgccctccggggttttttcgatggcatacacccgaatgcttcccgactggcaggctgcttccatgctgactgacccggttccagcacctacgtcatagagcacggcttcctccgtgagcgcaagttttgcgaggctgaccgcccggatttccgattttgtcatgggtaccctgccgcggatatactcttcatcttccatatgcaggcagacccgcttatccggactggggttccgtacataagcggcggcaagaccgtcaaggtcctgcggttccagctctctgcccctcttatggagaatctcctcctcttcataggagagatgttttcctatgtaaaattcggtctcacccaggccataatctcgtatcttctcacagatctcacgggcgcattcgattcctccgaacagcagaaacgtcttctcgtgtttcgcgatctcatagatgaaattctgttttcttccatgtatgctcacaagagcagcgtcttcccaggaaatccccagtcttgccgccagatacaccgcggaagatattcccggtatcgtataaaccggataatccgcaagctcttctttcagctttctggccccgctgtagaagccgggatccccggaaagcgccaccgccgccttcctgtattctccgtgtgatttcaggaaatcgtggatttccttcggtttataagagtgaaatacgggctttccaaatgactgcagggcatcggtcatccgctgcgccccgataatgcagtcgcattcccggaatatctgttctgcctgggctgttagggagtttctgtttcccatcccgattccggtgagataaatgatctgtttttctttacacattccgatatcctctgggagtcaccatcttcccgttcagttcttttgtctgttcatttccgataaacacggtggtaaacatatcaacctctgtatctctcagttctccaagggtaaggatcctgctggcttcctcttctctcccgatattgcgcacggtaccgcagaccgtatccgggcttttatactccagcatgtagtcacaggccttctgcaggtagtccttacgcttccggctggacggattgtacaggcagatcacaaagtccgccatggccgccgccttcagcctcttctctatcttttcccatggcgtcagcagatcgcttaagctgatcactgcaaaatcatgcatcagaggcgctcccagtaccgcggcgccgccattagcggcggtaatccccggcacaatctcgatctccacgtccggatactccgcaccggtctcgtatatcaggccagccatgccgtagatcccggcgtctccgctgcacaccatcgccacgtcccggccccctgccgcctcctccagcgccatctggcagcgctttacttcctgggtcatgggggtggtcagatacgttttctccgggtattgctgtttaatcagatctacatacaccgtatatcctacgatgaccttgcatttatccagcgcagcccttgcctccagtgtcatctgcctgtctgccccgggccccagccctaccacatataccttactcatttgtcttcccctctctgcttgctttccggaattccgtagtaaaagacggattgtaaagttcggatcggtcatagccgccctccagcacatccccgactacaatcagcgccgtcttggtaatgccttcgctctccccggtattggccagggtgtccactgtacagcggcagactttctgttccggccaggtggccttatacacgatagccgccggtgtatccttctcatatccccccgccagcagttctttttccagttccgcaagcatccccgtgctcaggaatatgaccatggttgcatggtgtgcggcgaaacttctgatggactctttctccggcaccggtgtcctgccggccattctggtaatcaccacggactgggatatcccgggaagggtatactctgcctccagagctgcagcggccccgcagaatgaactgactcccgggcagacttcatagtcaatgccttcttgtttcaatgcatccatctgttccttgatcgcgccgtacagacacgggtctccggtgtggagacgtaccaccctcttgtgatttttctctccccggatcatgacgtccagcacttcctccaacgtcattaacgcactgttatgtacctcacagccatcttttctaacctccagcaatgcgggatttacaagggaccctgcatatacaatgatgtcagcctcctgcagatacttctgtccacgcacggtaatcagatctgctgctccggctcctgccccaacaaatgcaatcatctacttttcctcctttaatatgatcagtgaataataactcgcctcatccggaatgtcctccgcctggcagtagatcttctctccgggcatcccgcagttctccaccatctgaacccggagcttcttctctttcactgcctgttttacgtaaggcatcttttttccggccttcatcagaaccttggttcccggcatctccaggctttcctcgatcccataggacgccggaataatatgtaattcgtccctgttttccacaaggccggaatccattctggccgctgcagcgcagaaagaagtgatgccgggcaccaggctggtcctgcatccccgttctttcaaacgcttgtggacatagaggcaggtggagtatacactgggatcccccagcgtaataaatgccacatttctgcccgaacgcaggacttcttctgtcttatccgcgcatttgtcatgaatctctttcagctgtgtcttttccttcatcatcggcatgggaaggaacagctttgctttacggacgatctccgggatcacgggcaggacaatctgccacgctacacatttttcaaggtaaacaggcattctgctctcagtgcccgcctcctcgtataccgcgtccttcagctccggacttgagaccgcaatggcaacgacctcacattcttttatggtgttcaccgccttcagcgtcatcagctccgggtctcccggtcccacacctactgcatacattattccgcagtttactgcggatccgtccgtagggcatgaattacggagtgccctttgggtatacattattccttcgctcatacctgctcccttctgatctgttccaataattcttctgcatttttcgttttcccaagaattccttcttctttggaaaatacgaccgccccgattgtcagcgtatctcccgcgcgctgtctcagatgaaattcaatccgtctgattaccgtctccattacagggcgcagtaactttcgttctttcaaataatccagggcttccgttgtcgtgatgcagtccatgattttctctgcatccgccgctgaggcgcctgccattgccgcatgggaggcaagcacttccatccggcagtccgcctggcgggaatgggtgttcataacccctgctgccagtttgaccagtttgcccacatggccgatcagcagaatgcctttcattcccaggctcaccgcatcatcgatggtctcgccgatatagttactgcattttacggccaggctgccgtcatattttaaagactctgtcagaaaatcgctcccataattgcctggcaccacataacaccagtcatgtccattctccttcaatactttcatttccagaaaaatcgtatccgtgagggccttttcactcatcggctctacaatcccgcttgtgccgagcactgagatgccgccttcgatccccaatctggggttaaatgtcttcgaagccagttttctgccctcgggaatcgtgattacaatctccagccctttgctgtagccgaacctctccctttgctcctcgaccgctcccaaaatcatctgcctgggaactctgttgattgcggcctctccgatctcctgctgaagccctttctttgtgactcttccgaccccttctcccccatccaggcaaagggatccatccgcggtctttttcacttctgcataaatatagataccatccgtaatatccggatcgtccccgctgtccttctggacagcacagcggacccggtccgggccaatgtctatctgctcgatgtccagatacaatgtgatgcctttcggagtcaacagggatacctgtgtgatgacttcttttgaaaggagcatgtacgcggcggctttggctgccgctgccgcacagctgccggtggtatagcccgagcgcagctgcttttggtttttccatactgtctctgcctgcgtcctgccttttggcagctgtttttccatggtctttctcctctctctgttacatagcggcttcaatatgttcaacaaagatattgcggattcccttcatctcgcccagcccccggatcagtgccttcacttcatagccggcgtcctccagttctgccttccaggaatcgtcttcccccgccatatcgttcttcgcatggtcacctgccaccaccataaacggcatcagcgttaccttgcggattccggagatttccagtttcgtcatgacgttcctcagatctggaaaaccttctaccgtgcccaccagcacctgattgtagccaagtgagtggaaggtatactccagggtcgggtatgctgaattcgcatgatggtctgtgccgtgccccatcaggatcagtgcctcgccctcctccagggtaacctccgccatcatggcatgaatggatttcttatagtcatccacactggtaagaagcggatttcccacgcgtatcctgcggaatctgtctgtgtaatccatcacgtccctgagcattctgtcgttctctatcccgttgataatatgggtcggctgtacaataacctgctcgattccgtcctctgccatctgttccatggcttctttgacattcgctacgaataaattttcctttttctgcagtttgttcttaatcattttgctggtaaatgcgcgatagattctatagtccggaaatgactctccgatctgcttttcaatcgccgttatgtttttctccagagtgtccagatggctcgtcccaaaactcacgacaagtatggccttctttcctgttatcttatccattttctgctctctctttcctattaatttctgatatcggccttcaccgcctcttatgccttggaggaggcctctatataatattccagttctcttatattcacaggcggcttcagtccgcctcccagtatcccttttttctggagccgtgcaaacagctttaatacggcgggttcttcctggttggtcatggccagcgcctcctgatccgtacacactgtgacgggatccgcatgccgcagtactcttccctcatgcatcagcacgatctcatcagcccaggacagtgcgtaatcgatatcgtgcgtagccatcagtatcgtaattccttcttccgccagcccatctacgatctgattgacgatctttgtatgttttgcgtccagcgcggccgccggttcgtccagtatgatgacttccggatgcatcaccaggatgtcggcgatggaaacctgctttttctgtcctccgctcagggcatgggccgggcggtcccggaagggcgttatctcaagatggccgatcacctggtccacttcctgtcttgctttctcttccgctacacccatgttcaggattccaaaggaaatctcctggtacacgcttgccgaaaacagctgattatccggatcctgaaagacaatgccgaccctgcttctaagatccagcaatccctttttggagtaatccaccggcttcccttcaaatagaaccattccctcatccggcttatatatcccattgcagcatagaaaaaaagtggactttccgcagccgtttgcacccatgaatgccacctttttccccctttttattttcaggctcacgccgtttagggagtgcgggcctccttcttcatatgcgtagtggacatctctcgcctctattatgacatccttttcctctgtattcataagaatctcctccatattgtcaatgcaagcaggatcacttcaaacactgtgattgcagcgacctccttttttctggccggatgatgttccgcaagtactctgatcctgccgtcgtagcacctggattccatggcgtcatacaatgcattggatctcttaaatgcgcggagcagcaggcccgcccccatctttccgaaggaactcaccgatgttcgcagatctttgttgcccagcctggacttctgtgacaccatcatggcggaagcagtctccatgagcacaaagatgaaccggtagatcagaagcatgagttccgtcaatatctcggggcagtgcagttttgccagcacgtccagaatatctgtcattgtcgtattgagagataaaaagtacaggcaggacacactcgccatggctgtcgcaatcagctgtatcccgaatagaagggaatgaaaactccctgtgataaaaaagctgcccactggaattgcataagcatccagtgggacttttgagatattgactataatcgcaagtgtactcaatatcaggaatgtaaaaggcaccgccagcagctttgcgtattgccccgccgctatgcgtccttttttcacggtcaggtatgtattgactgcaaacgccacgcctgcaacgatgagtgagcggctgactacacagaacagcagagttatcatggaaaatgcaaacttttcagccgcatttacatatcttaatctggagcgataacagagcttatctactacaatcatgccgccctccttcccggaatcttattcctctttattccatctttttctgccatttttttctttctacgaatcgtcccatcacaaaagcgatgatgccaaccccgatccctgtctggatacaaaaaatcaagctttctacctcgccaggcagttcgccgcccagcgcagtctccagcaccggtgtaaaccatggggtgtattccccctgaatctcttctatcataacgctccccgcgtcatcagagccgccgaactcagcgcctttcttcgcgaacaggggcacaattgcaattaatacagctgcgatcagaagaataatgactgtttttgtatttttactcatcctattttgcctcctttaaaaatccaattgccttgagttccggttttgcatatgattccaggccgatgacaatgataaccgtaaggatgccttcgatgactgccagcggaagctgggtcggtgcaaatacacccaggaatttaacagcagatgccgcaacaccgccggcctcggatgggtaagcgagtgcaagctggatgctggtcacacagtatgtaaagatatcgcccagaaaagccgccagaaaaacggatacttttcggttcacattcatttttttacagagctgaaagattccaaacgacagaagcggtcccgctatcgccatggaaaatgtgtttgcccccagtgttgtcaatccgccgtgtgccagcagaatcgcctggaacaaaagcacgatgattcccagtacgctgactgccgccgggccaaacaggattgcccccagccctgtgcccgtcatatgggaacagcttcccgtcacggacgggattttcagggaagaaatcacaaaaataaacgcccccgccattgcaatcaatgtgatggtctttctgttttcttttaatctttttttcagggaaatcaggccggcaaccaggaatggaacacagataacgccccaggcaatacagtatttaaccggaagatacccctccataatgtgcattgcattcacagccggtgtgacggcaaacatcagcgcaaacgcgatggctgccttgagtaagaatttttctttttttgacatatttctctctccttttttgtgatatgttgtcttgaaatacccccaggtataccacaaaatcgtatgagatctgcggcataacacccggtcatatccccgtaaccattcagatccatttaaaagcgggttttctgactcaggcatcaacacggtattccgccttcccatgaaaattctcacagtgacatcatggataccattccacctttacagcaacgggtattgtgcaggatttccacctgcttcccctgcggccgtccgctgcagatactatactccacttggacagcttacttttaaattgtatgccagacctgaattatataccgaaagggtaacattacccttttggctgctttttatcggaggtatctccccctaatactcgatcccccgtcttgcccggatctcccggtcaaagggatgtttgatttttcggatctcggaaacataatccgcaagcccgatcagcttttcgtccggatttcgtccggtcagaacgacctccagttccttaggtttcttttccaaaaaggccagcgactttgtgtgatcaatgaggccataatgataggctgccataaactcgtcgaccacaagcatatcatactctccggatactgctttttcacaaaccgtatcccacagccgtgcataagtctcctgagcctccgctttctccgcttcggacagcgtgttgaagaatccaaatgatttgtccatatggagtaccgtaattccctccacggcatccagaatcttgagctctccggagtcctcgttcttcagaaaacgcgaaaaaagaaccttcataccgcttccggccgctctgacagcaagccctgttgcggcagtcgtcttcccctttccatctccacagtaaatatgtatcagcccgtttttcatgcgcccacctcatccaaaatccctcttattttatcataaattgtctgattatgcaattttcactatctatcattgtatatgattttccgttcttccgtttgtacttttttcttttgtttatgtaattttttaagaacgagggcaaaggggtcagacccctcttcagaggggtctgacccctttgccctccgtattcagaatattctgaatataaccctttatttcttccacactgtaccctgtttctgcaggccttccaatcactacaagcgttacccctgtctctctggcagcctccagtttttcctcaaacccccccgctttgcctgattcctttgtcacaaaatagtctgctcctgtgtatttcagcatggcagtatttaattctttcgaaaagggtccctgcatggcgatgagatgggagcccttgaatccaagctccacgctctcttccacggactcttttgtcgaaagaaccctggcaaaacagcgttctttgtaatggtcgatcgctgtgtacagccttaattctttgctcccggtggaaatgaatatccggccttcccgtgttttgagatactctactgcttctgccacggaatttacaattaccatattgcggtaagatcctgcgccgcctgtcccgctttcgtcccgcagacagcggatataaccggcgccgctccccttacaggcattttgaatattctccgtggccaggcgcgcaaagggatgagtggcatcgatcacaagcctgatctgattctccctgataaatccgcagatagcctcttgatccatccggcccgttatgacccggatattttgaattccttccacgcattccattccgtactctgtagccgtactgacgaaggctggcgcagacagcgtgcctaaaaattcagccagcattcttccttctgatgttcccgcaaacagcagaatactcattcttccgttctccatattccttttcctccccttttccgcagcctatttatgtctgatacttagattttattttaagtacaacaactggcatatcctggaaatattccggttgtgtttaaacctctttcacagtataatatatcacatagcaaattgaaaccacaaacataagggagcttttatatgttttttaatctaattggatttattcggaaagacttagacctaaaagaaacctattttaaaagtgcggaaaatgaaatcgcaaagaaaaatctgatcctgcttcaggtttccagtctgctcaatgtccttctccttgtcttattttacataataaccccgtttatcattaaaggctggacaatcacattacagcattttctttttctcccggcggcactggcctttttcatcatctctacagtttacgcaaagacaggccgcagagacaagcgcgtgataaccggcatctgcctggctttcgaaatcacgctgtttgcttttgttatttctatagatgtctttccttacccggatgctcccagctctttcctaccgcttttatatattgcgtttccagcgctgttcattctccgtttccgtcagatgttcacggtcatgtttctggtcgaggtcgtatacgccgttgcagtcttacagataaaaaatccgctgatggcagaaaacgacatctttaattctgtcgtttcctttatcttttcgctggcagtcgcccacgtaatcctgaaactccgcgccgatgaccacgacatacgcagccgttacaaacgcctgagcatgctggattccctcactggcattctaaacaaaaagtcctgtgaaaatgcaatttcccagtatctgaatacaaacgcccccgtgtattgcgccctgctctttctagatctggacgacttcaaaaagatcaatgataccatcggccactccgccggagaccgtcttctggaagagaccggaaaattactccacaaaacattccacgcatcagatatcatcggccgtgtcggcggagatgaattcatgatactactcacaaactaccatgattcaatagagtccctgaaaaagaggtgcaccgccttgcagcgcactctccagcagatcatgcagaaccacggagtccaggctacctgcagcataggcgcactcctggtcaaaggacggtgaatcagcttccaaaccgcatacaccctagccgacaaatgcctgtacgatgccaaatcctccggaaaaaacaactgcatagtccaaaccctgcccaaagaatgatctcagcaagcacttaataaaggagcgcatgcgtatgaatacgctgactgctccaaaaaaccgttgccggatatgtgtgctccatacccacatatccggcaacagttttttgaagcagtcagcagtacgggtacaaatcgcagcggcatatacagcccctatgtcttcccagcatcactgacatggagcgcccccttctaactcattcccccacccattcatggatctcgccgcaggcaatcatttcgccgctgtctcctgacggctgtgtcttaaaatcatccgggttcatatggatgaccactgttctgccgaccacatcatccgggtaaaatctcccggtatataccgcactgcaggctgcaccgtgtgtagacagcagaggcggcagatcaccggcatgttccgggtgatccgtatgttcgggattaaaatgcccatcggcatctgcgaaaggctcctcagcattcccggaacattgtttcccttcatgaatgtggaaggcaaaaaatctgctcatgtccggcgcattttcatccggcagcccgtatacctcagccaacacgatcgtccctccgtatacttcatagaaataaaccattccatggatctctgggtatttatccgatccttttatctttgcagaagcttccggcattccgtttaatttatcaaccatatcatcatcctcctctgctcagtatatgcagcagcccggaggatgttcatgctttgcgtaaacaaaaatcactgcgcctattcaaaatacatatagtccatataaaattcattaaaatgtttatcgttggagagctgtacttccgatgaactctccagaatacgctgcacgcgctctgtgcagtcgctgcttaacaggtatgtccgggttcctttcaggcagctgtttcctaccgcctcaatcttatcttggcattcttccggaagcagcccgattcccacggcttttacgatatccatcttatatccaaagcctcctgcaatataaatagccccaatatcatcataagatgcgccgaagttcaggatcaatgtctcaagcccggcacgtactgcggacttggcaagctgtatttcccttacatccttctggaaaaatgagatccccgtcccatcgctgctgacagcaagcggaaagccgtcgtcgaaataatcttcctccattagcccagtctcatccacaagctccgcctttaccagctcatataccatatcgatcaccccggtgccgcagatgccgacaggtttggcatcctggatcgtcccggtaactgcatggccgtccttcagttcgactttgcagattgctcccggcacgcttcccgtgccaaaggtaatattgccgccctcgaatgcagggcccgctgccgttgaagtcgtcaatatcctgtccttattgccaatcgccatctccccattggtacccagatccaccaggacagacaccttttctctcttatcaaaatccagagaatacaggcctgccacaatatcgccgcccacataagtagaaattccagggaaaatcactacctcaaagtccctgtcttcctgctcaaacagttctttgtaagttgtatgtatggtgtcaatgttaactggggtgaaaggaaatacgcccagtgttttacaggagtaccccatcagcaggtgtaccatagtcgtattggctccgattatcatcttctccacccggatcttcccattttctgtcaggctctcaattccctgcatcaggtcagtctggatactttttctcagggcttctcttttcccgccgttggaggcctcaattctgctgattacatccgcaccatacgccctctgcctgttgattgtagtgaaaacgtcttccgcttcctgtgtctccatgttgaccagctgcatggcgatcgtcgtcgttccgatgtccacggcgattccataccggcggccggtctttgcactgcttttcgccgcttttcccgctgtctgctcctcatccgccagaaccgcgaattcttcttccttatgcagcccgacagcgatcacgcagtcatcctcaggataggccttacatgccagacggtatccctcctgcagctgctccccgctgaagaacttcctgtcctgctctgaaggcgcaatgtccccttcaaggacctgtattccgcatttaccgcaggttcccctgcccgcacagactgccggcaggaagattccctgttcctggagaagttccatcagcgaatgtccctttctgccctccagtactctgatgtcgcctccgtcatgaagcgtgattgtgtaatccgagacatttctaaggctgcagccgacattagggcaacttgcacaattatgatggatacggaacatgtccgaatgatccgtagtcaggtaaacctgacaggtcgtcttgaccgggtcatacatacagctgtccagtacacggatccctgcactgttttctcttgcggtcacctccagcgcctttttctgggcctccatcggaatatcctggggcgcctccaggcggcgggaaactccacattttttctccctgcacatggcgataatatagggctgaagctgatggtccatctggaaaagatagtcatccgcaatggcatccgccagcataccgcccagataatccccctcattgaacagctgtgtggaccactggctcagctgaccgcccaccgaagtgacacagtagagcgcctgatggattccctctccataccgactgagctcaaatccctccacatcaccgaattccagcagtgcgattggctctatttttttatatgcttccggaagcatttcctcatattcttccattacatcatcgtaggtagcgctgtcttcataacagtctatcagggaaaatacattttctctgcatatctctatattaaattccgttattttcatgttcttatcctctctcaactaacggaagtctaagctctgcccccgcagttttgacaaccatatccgtacttgcccaaaaccccgggcaggtatcagtatttcattcattttccagtataaaaagaaaaactccttgtaaaaagagtttgctgctgacacactttatataattcaaacggaatcctgtttcccacccaaaacaggtccatagggatatataagtatcctggctcacgtttcatcctaggaatgccttctcatcctgacggacaatggctgttattcttcgtccacgtttacagtaggggtaagcctgcaccggatttacaccggtttccttcattcgatgctctttgtcactataatccgcactttcccaaagggctcttatttctccaaaactgctttcttcgcaacttctgctgctgttgctgcatctggtgtatagtagtctgctccaatctgctctgcaaagctgtcattaaccggagcgccgccgaccataacgatatacttgtcgcgaagtcccttttcgttcagctggtcaatgcagtcctgcatcttcggcattgttgttgtaagaagagctgacatacagatcacgtccgcgcctacttcttcagccttgtcgataaatacagccggttccacatctacaccgatgtcatggatctcaaatccagctcctttaagcatcattacgacaaggttcttgccgatatcatgaaggtctccctgtactgttccgattacagcttttccaaccggctcattacctacctcaaccagttttggctccaggactgtaagacctgcattcatagctcttgcagctaccagaacttccggtacaaatacttcgttgttcttaaactttgcaccaatgatcatcattcctgataaaagaccttcattcagaatctcttttggatcgagcccctcatccagagcctcctgtaccagtgcctttacgttctttgcccttcctttttgaaggaattctgaaatttcctgaatctttgacattttacatacctccatcattcattaagcgtgtctgctttagttatcattttacaatatctgctgctctgtttttagtaatttttttggaactctttgtacaaatatctctttttttgtttactttttcagttccgcggcaatctcgggataccacgccatcgcttttttcaaagactttttaacgggcaggccatttcctgagagaatcaccagatcattgacgtgttccggcttcccttcaaacctttcagcctggtagatactgcccacgcagttcacaagataaatctccccctgcacttcaacaaatcctttgacacggtaagtatcatccagaaacatttcaatgaatttctgaagttttttcagttccaatcccggattcaaacggagcaggtattttttcaaggtaatatccgcgctctgtatcacaggctcttccggctggttatccggaggagcggcaggattcagccagccgctttcgatccggccgaaggtggtcgtatgtacaggaacctccgggcggtgttttctgataatgccctttatttcctcaatctgttctttggatgccagatccgttttattgaccagcacaagatcactgaccgccagctgcttctttaccacgactgccgtctcataaaccttctgaaactgtctcgcatcaaccaggcagatgcttcccatgtattccacatctgagaatttgccttcctgatgcaggatttttctgacattcataggattggagaggccggaagcctccacaattattatgtccggtttttccgaaagggctttttcaagcacttcctcgaatttatccagcctgcatgaacagaatatggaaccgttgttgatctcatccagcgccgttcccagttctctaagaagctccccgtccacgccttcttttccaaattcattgataatcaaatgcagccggtagtctgacaattcatttataaaattttttaaaaaagtagttttaccggctcctaagaagccggtaattaaatacagtttactcattatttcatacctcattctgctgcttagcagcagacccgcccgttagggcctgaattacggtgtgaccttagggcataacagccttgattgctgcctccaattcttctttcgcaggtacaagagaacgaaattttaattcaccgttaatatacatagacggaaggttcggaactcccattttcttgcagcgtgcaatgttctccttgatcgtaaacttatactcgatcatatcaattgcgtcaccgaatgtctcctttgcctcattggcagcgcccatcatatacgtacatgccgcacatgttgcggaatccagtgtaaatacttccacaagcggtttctccaaatgctcgtaatccggcagttccacttcaatatcctcgtctgcagccacatagtttttcaggatttctcttacggagtccggctcatggattgcctgtactacaccgattgtgttctcaacaggaacagcatacggcatatcacagcccggagcaaggatgaagtttttcttgttcggcatattatccagaaggtcgatcacgaacttcatattatcctgctgtgtaccgtgcagcatgaccgttgtcagcgggatatttccgccaagcgccacgttgtacttatccgtgatcgcctttgctgcaagcaggtccacgttctcatcgatagagatggaatcagggcctgtctggcacattacctcgatgttccttgtcgcatcgccgcatacaaagaaggaagacagtgcgcccagttctctgatatggtcaaacagcttcttgaacggtgcgctcatgaacatctcaaaatgatcagaagaaatctgggaaatcagcgggtctactactgcgatcacatccatacctgcttctatataatattcggccatcttcatagcaatcgcatcacagtattccaggaattcaatcacggcatcctcatcgtcgtacatatccatgaaaatgtcattgccgcgcagatgtgttgccagtgtaaaaggtccgcagatcaggccgtataatgcagttgtatcaccgaccgcttctttcatacgcttcataacgtccatgatcataggaatacgaccggattcttttgtcggaatggtgcagtagcagggtgtctccagctcctcttctccttccatcggatggctggctacagacggcggagcgtcgtccgcccacaccagattacatcccaggcattccgcctcaacctgcaggtcaaagataactggctgtcccgccggtttatacaacttattcacttccatcagagattcaaacagtttgtccccgtcctggagcacttccgtagctgtatagcccagaaggctgcccgcatgcacgcctgcaaatggtacccatgccacctggtctgtctccccgtggtgcagtgttttgataagaatttctttctggttcattttgcttcctcactttcttttttgcaatattttatcttaaaaactttcatgatccacatgtatcatagtctgcctgtgcaagcattgccctgacttcgggtatggaacagccccggtttgtcccggtttcaacgctgcagtcccttgggttaatcccgatctccgcatacagctggtttacgcccgcgagcagcgccatctgcttcggctcatggacattcatagactgtttgggcctggttaccagccttgccgcagcgacaatcttggccagttccagatctgtaatctctcctttatcaaaaagaggagtacccggcacgcctacccgtttcatacaggccataacatttacactgtattctctggcgcgcagcatttcatctgcaatctgttcgtatgtatgttccggtccgatcggctctacacagtagatcaactccaggcccgctgctttaatggcatccagagtcgcaattctctgctcctttggaagatccgtatcctgtccctcgttcattctgacaatatggtaaacgcctgtgtatcccacttccttgagccgctttgccgtttccagtccaaagtcaccaatattggcaataaacatcatctccggtgtcagcagttttttcacttctccggaaacctccagaaatctctcaaccccgtaatccgccgtggtcataagaaacagggcgtccgccttctcctccactgccctggaggcttctgcaagtatgtcttccaacggcttttctgttttatcctctactacaaaactatccctggcaagggaacagaacttgcaattcccggtacatggcgcactattgagcccaatctgtgcaaatacatatccctttcttccatactctcttctggagagttcattcgccttagccagtaatgcataaaactccgaagaatgactgtctatactaagaagttttactgcatcgtcctttgtcaaatcctgattctcatcaactttcctgaagattgcttcaagcccgtcgacatgattagaaaaagaaatcatcactatgcctcctatctgttctgaattcatagtaagatttcttttcttttatttcttgcaatttctatagctaaattgtgatttttttaaggtgttttaaaatactcaatattctatcatgcgtacttattcttagaagttatctattgagtgcacactgaatagataatgaattcttttagtaacaaaaaagtacggttaattttgttgctgacagatatatagtttagtgttgatatattgtatacttttacgtagataagttaatgtatgttgtgcaattttaacacaaacacaccataatcaaaaagatttataaaggaggaagagtatttatggaagcaacaacaaatgaccagtacttatgtttcacctgtggcacaccccctgaggaagtagaggaccgtgaggtaaaaaagagtgcatgtccccgtgcgagaaaattattgcaggaattttatgatgcaaagatttctcttgacacaacgttcccttactggtacacaagaacctggatgaaagaagaggggcagcatccgctggtccgccgcggacttgcaatgaagagtgcattctcccaccttgaggcagcaatccgccctgatgaaatattagttatgagccgtaataagtatgtccgtggcgccagtattactccgtggacagcaaacgagtttcctctgagcgatgaagagcgtgcaaagaaagacagcaagaaggcttcaaataaggctcttgaagaaattacgatacttgcaaccggcggcggcgtcgtttctgaaagcactccggaggttctctctatggcacgtcgttatggtatgcgcgttgaagaacatgcggctttaatagaaatttgccgttactggcagaacaagtctgccgaggatacatgttggaagtggggtaccctgcatcccgagtatgatacccttgtcaatttcaagaatgctgtccttatggctgccgatatggagtacggcaaccgtcacggacgcagtgtcacaaactaccagatcgtatttgaaaaaggcttccagggtatgattgaccgctgtaaagagctgattgctgctaatgtgggcgatggtactgcagtagataaagttgcttactggcaggctacaatttatgcaatcgaaggcgtacagatttgggttcgcaagtatgccgctgaagcaacccgtcttgcttctcttgaaaaggacgcagaacagaaggccgttttcgaagccatggcagcgcgccttgagtggatttcatcgaatccgccccgcgattttatggaagcccttcagctccactggacctgccagcttgaggtttacaacgaaatgcagggctctggattttctcccggacgccttggccaggttctctatccctactggaaagaggatattgataacggcagaatcaccagagagcagactcttgaggttctcgaatgtatgcgcgttaaatacacggaacttgagattgcaacctgtgcaggtaccactggtatacttgcaggtaacacatttaacaacatctgtctcggcggtgtcaagcctgatggctccagcgccgaaaacgaactggaatacttattcatccaggccgcaattaattgccctactgtttctccaactctgtcgattatttatgacggcaggctgtccaatactttcctgcaaaaggggattgaatgcaacaagaccggttgtggtatgcctgcctgggtaagcaaccgcgtcggcattgaatactgtatgaagaaccattcatgtgaagggattactcttgaagatgcaagagcatggagtataggcggctgccttgagatccagcccggcgctgtatatgacaacaagattggcgcaggttcatacagttcttcaggaatcaatttcattaatgttccaaaggttcttgaactggtactttttgatggtgtagatcccagaacaaatgtccgtgtatttccggcaaccggcaaaaaatacgaaacatttgatgaacttatggacacctttaaggcatatttcaaaaaggtgatccagatttttgaagaaacttataatatgaaggtatctgcaacgtttgagcttgaccagccgttatttttctctgcactgtctgctgactgcattgaaaagggagccgatattgaccatgcgggttctcgttacaaccgctgcttcacaacatggattaccggtcaggttaacacagcaaactctcttgcctctataaagaagaatgtgtttgacgaccgtgcatttacacttgatgagcttaaggatgtcttacttaacaacttcggatttatcagtgcactggatacgggcaacttctccatgatggagcagactaaggatgtttctaaccctgactgggaaagaatacacgctttgtgtatgcgcgcacctaaattcggtaatgatgacgcttacgttgacgatatctatgtccaggtagcggactgcttcctggaatccgtggaagagattaccgatgtattcggaaacaagtggtgtgcatccatgctgtctgtaggtacccacggaccgcttggccaggctgatatcgcttctgcagacggccggctcgcaggcgttactctggcagacggcggccagtcaccttaccccggcaccgaccagaatggaccttacgctgtacttagttctgcaactgtaatcgaccatacaaatttcaagaatactcagctgaacatgaagctgcatcctgcatcaattaagggcaatatgggttccgctaagatgctcgatatgattcgttcctttatggataacggcggcttccatatccagttcaatgttgttgattcccgtatgcttaaagatgcgcaggacaatccaaataattatcgtgatctgcttgtccgtgtggcagggttcacgcagtattggtgcgaagtttccaaacctattcaggatgaactgattgcccgtacagaatatgaagaagtttaaggaggataatatgatgtgtgataaatgtaaggattgcgccaatctgtctgcccgcgatgtgtttaacggtgtatgcataatcagcaaggaaacagtttctatcgacgctcctgtttgtaaaaaatttttacgtgctaataagtgcaaatattgcagcaaatatatcgtatctgagaaagatcccaatctcggcacatgcgacggcgatatggtttacccggatctcggcggctgcgaggattttactcctgcagaataatggtatacccaaagggcaccccgtaattcatgccctgacgggcggatctgcagcaaagctgcagaacaaagtatatgtttctaactgttcggtacaggactgtgcattccctgcacagtccgtacggaaacatcagttacgcagcagcaggccctcttgccaaaaacgattttcatggggtacttttccaagaagaaaaaaatcaagttaataaaggcatttattttttcttacttccgttttctttaaataatgatataatatcttatatatatcggtacgttgtaacaaaaataatcaacaggcagtccatgagaccgtgtactggattgtcggtttattttgagtacattattatatcagaaagaggaagtattatgccaccaaaagtaactgtaaaattagtcttagaagaaccagagttgcaaggagcccttgtattagccggagaggcaggcttagaccgtgaagtgaaggcggtgacagtggcagaaattctcgatatcgccttttatttaaagggcggagattttgtacatagtgttgcatcttttatggatgaacacagtgagaatcaattatccgttgaggccttgtgcgaatggacaaaaaatttaatagatcacggcgccagctgccttgctattaaaacgaagcggtatttaaaagaaattccggcgcctctgctgcagttaggcaatgaaaatgattttcccatcattgaactgcccccgggagatacgcagaatgatgtaacgcaatgcgttttaagagttgttatggaggcggaagagcaaggtaagaatcgcagtttaacagctctttctaatctacatgatgccgtggttaatggggcatccatcgttgatatatcacgaatatttgcaggttatttgaacaatccggttttaatcgaggatcatgagtggcgttatgtgacgtgttgcgacaatcaatcagcaggagctgccgaagccttgcttgcccgccgacgggaagaaaatctgcaggtgatagtagatcatattgttggcgagtcatccatccgcactcaagtggtcatggataatagaacgatttggcaggaaacatggccaataatattcaaagaaaatgtcataggttatttcagcatttgtgaatatgagggggcaataacatccgagaaccgtcagcttgtcgagcggtgccttgatattctggctttgacaatttatcatcatcaaagctatattgacagtactgcatggcataccggagaagtatttttacaggctcttttggcggaaaattatcaaaaagaagttgtcagctattttgctcaaatgatgggcttcgatgaacagaagaatatgtcagcaatcgtcataagtccgatcagcaaagcacagaaggagcagctaaacagtaaaaactggtctaaatatcattatttcacagagtatgcaattcacagcatacagagtttcattgcgcagaagaatttcaaggttattctgggcggctattacggattccttgtagtatttgttgatactggatctaaggggattcgggacatgaaacaaattggtatgtcaatttgggaatcattaactggcggaagaatgaaaatggatgttgtgatggggattggatgcataggcaagggaatccactcttaccgtgaaagctgtttggaagcgcttgatgttgtgcgttgtatccgcaggtttggtctgaaagaaaacgtgatgtgttacgatgaacttgggcattatgctctgctgaattctatcctgcgtaaagatgaggctgcactgcgttatagccaaacggtgcttggcaaattatataatgacaaagatgcggaagagttggtaagtacacttagtacatatctggataaaaattgtagttatatagaaacaagccgtgcactttatctgcacgttaacacagtaaaataccgcattaaacaaatacaagaacggttgtcagtagatctttccacccaagacggtcggtgcagcatttggttagccttaagcattgatcgttatctaaagtgatattgttctgcatggtctccgttcgggaaggaatcgtttagaaaatgaaactcaattcaaataacgaggctgtcatttttgatatccagggtttctcggtgcatgatggtcctggaggccggacattaatattttttaaaggctgtccgttaaaatgttactggtgctgtaatcctgagagccagcagctgcagcctcagctaatgtatcgtgttagtaattgcgttaactgctacggttgtgtaggcaggaatatctgcccgcataatgcgatttccctgccaaagcaaaagggggagcatgtctcatttgaccgtaataaatgtgacagctgtgatacaattgaatgttctgaaaattgttatcatgaagcgctaaaaacggccggtaaagtatacacgattgatgagattatgcacagaatagaacgggaaagccgtttttggggaccgggaggcggcgtgactttaggaggcggcgaggttgccgtgcagtataagtttgctgctgagcttttgcgccgctgccatgagcgttatatcaataccgcaactgaatcctgcagctttgcgccttggccccatcttgagcagatttatgaaaatgtagactgggcatttaccgacataaaacatatggataccgaaaggcacaaggatgctactggggttggcaacgagttgattcttgaaaacatagcaaaaattgccgagcttggccacaagggtaaacttcgccatatcgtacggatacctatcattgatggttataattctgatgaagttaatattgtaaaaacgattgcttatataaaagagatcggaacgaaagaggttaatattttaccattccaccgtttgggggcctccaaatatgagcagcttggccgtatatatgactgccgcgatatgactggctgctctgaagatattctgcatcgtattcaagtacagtttcagacggcaggattaacctgttatgtcggcagtgatactcccttctaaacttctctgccactgttttatctgcagggtttagcagggaaaggatatgagatgtaatggacagtatacgaattttccttgttagcctataaagtaagaataagccagcccgctccggtcagaaaacagggttggcttatttattcgtgctgattattccttatttttccaacagcagccaattcgcccgaaacggccgcatcagattccagtaccccacccccagcagttcatattctctcgccagattcagctttgcctctatgctcctcacatcctcaaaccagacttcatgtgcaatcccgttccttgtatagttaaagtgagggctttgtgcaagatcatcgtattgtatcgataccccgttttctgctgcaatgtgcacagcctccacattgccgatcagccttgccttggtgatccctctttcatagggcagcgcccagtcataggcatagttgggaatccccatcagtatcttttcctttggtatctgtgtcagtgcatactccaccacctggcgcaccttattcaaaggcgccacagccataggcggtccgtatgtatagccccactcatatgtcattagaaaaacattgtccgcattcgcgcccagaagtgcatagtccattccctcatataaaaggcccggctgaccggtggaagtcttgggtgccagcgcaacagatgtcttatatccctgtgcattcataacttcccgcactctgccaacaaactccgcatatgcaatcctattttccggaaggatatactcaaaatcaatatccactcctgaataccccctgtcctgtacggtggacagcaggttgtcgattaccctctgctggatcacttcattttccaccagcactttcaccagctggttattaaaagcccctcctgagaacggtgtcagtaccagcagcggttcaataccggcctcccaggctgcctcaatcatccagagatcgtcctgcggaggcggcacaagttctccctcaaatgtaaaaccatatgaaaagaccaataattcattcagggccgggaacgcctgttccaaaatatacggctccacaaatggatatgcatatcccgtgactaacatatctccacgcatactcgcagactcttccggctgcaggataaggagtgcctgcccgatcaccagctgatcctggctcgccagctgattgtcatataccattttccagacgggcacacccgtctgtgctgaaatggaaagcaatgtgtctccctgtttcacaacataaatcacaaaatcaccccctatgtaataacatatgagggtgattttttatttatgcccaaagggcatcccacgactgtcttatttgtattcgattcccaatactctgcaaagcgttgactgcagcacgcttacatcaattggttttgcaacatgcgccgtcattccggcatccattgaggcctggatatcctcggcaaacgcattggcagtcatagcgataatcggtatatccgccgcatcctgcctgttcatccgcctgattgcgcgggttgcctcatatccgttcatctccggcatctgtatatccatgagaattgcatcataggcacccggcctgttgtccgcaaattcttttaccgtctgcagcccatccgtttttacaagggaactggccccatacatttccaggagctcacggaggatctccgcattgattgcattatcttcggctatcaaaaaacggcggcctgcaaggaaagcagtatgttcttttctttctcccccatcgtcaggattcacagctgctctgtccggttcccccgccttttcacattccagagtgacctgaaatacagttccctggtgctctttgctctccacggttatgactccgcccatcagatccaccagcccccttgtgatactcagccccagcccggttccttcgacacatgaagtattgctgctgcgggaaaacggctcaaaaatatgttccaaaaactccttcttcatccccacgcctgtatctccaattgtaaagcagtaccggacataaccatccccacgtacagaagacagttcttccgccagaaatacaaccgaaccgccttccggagtaaatttaatcgcattactcagaatattaataaagatctgattcaggcgcagcatatcgccataaaacccgaagtttcttatgccctcagcctgcatatgaaactggattcctgccgccttcgcctggggctctatgatcgctgccagttcatccatcagttttggcagatagattttcattcttccaagggcaatctgggaccgctcaatcttgctcatatccaggacatcattgatcaggctcagtaaatgcctggatgatattgatatctttttcaggcagtccgatactttgtcccggtcgtcaatatgtgcacatgccagagtagtcatccccatgatcgcattcatcggagtccggatatcatgactcatggccgagaggaattcgctcttcgcctggtttgcctcctcggcaagtacaagtgccttctccagcgtccgttttgtctggcgctctgccgccagcatatctgttacgtctgcccgtaccatacagattgtccggtgattctcgtcgccccacaggacattgatctgcttatacagcacttcctctccctcttcataaggaaatacaaaatcatatccctccggtttttctcccagcctttccaacatcgtttccacacagaactgcctggaaatttcttccctgtcttctgccgttccaaagtggagggcaaactctttcaccgcgtcctcgtatttctccagataataaggcgctaagttcttgagtaccgtctcacgcgtatacattgtcagggatgtggaattcatatttataaagcaggcaagctcaaaagtataggcaatcatattgagcagcccctgctgctcgcgcagggattctgtaatatcggagcgcaccaggcaggctcttccgattcgcagatcaatggcagagaccgtcatattctttgtacgtatatcgccctgctcatccgcaatggaaaatgcaaaggtgtaggaccccttttccgacaggcgtttcatcagttctcctgcctccagcgatccccaatactgttcgcggtctttcggcacgacaacctcttctgccatgaaacggattctttttgaatggcttccgaaagtatccggcagcctgtccgaattcttattatatgccaggagcttataagtatcgtttatcagatctaggtcaatcacaaaatcgtagctggtcacagaaagctgatgcagaatccggtttgtgactgtctcgtccgtaatgtctgttaccgtcagaatcccggtgacatcgcctgtatccggagtctctaccaggttcactttaaacttgacatgacgtcccttttcctctttaggaagtttaataaaacaatgaagtgtctgctccgtatcatttctgccaaatgctctcagcgtgggctcgttcaagaaggtttctaaaaagatctgccgctctttttcgtccgtcacgaggctcgaaataccggcaaaaaacttttcccgttctgcactgaatgtcttcagcagatccgaatctgtatggtcgataatctccagaatctggttctgggttatattacagtgcccgataatcagtgcattcggatccggcgtccggtaatgctgcataatcatctctttatactgctgccggagctgctccttctcggcgatctctccgctgatatcgtgatagactgcgtagaactttctttcgccgctctccatttcaatcagagaaaggttattcttgacccaaacgtagctgccgtctccccgtttcagccggtacaccagttcacactggcttgccccgctttcaatgaattccgtaagccgagcgttcacccgctccagatcctgggcgttcacgccggccatagcatccgcactgtacagttctgatatttcttcctgggacatgcccgtcagctcagcaaaaccttccgacacgaattcaggtaccatgctgccgtcctcgcaaagtttaactactgcaattccccccggcagattcttaacaaccgtctgaaaatactgttccaaccgttctttttccctgcgtgttctcacttcttcggttatatcacggacatatttcacatatgccggtataccattccaatcagtctcacggaaacgcgtgctgaaaaaacggttctgcccgctgatcttcatctcatgctcccgcccgtccgcctcatattttgtcagaccgcagaaatcacagggagcgtgatttccatagattgcttcatagcattttcttcccacacagtcacggttagtcagaccgtcttgttccggttcattcacatataaaaggtcataactctcctttgcaatgatataaatgctgtcagccatttcgttggcaatactctgaaacagccgggtctccaaagacataccggtaaataccgcatagaacctggtattttccgagagcggccccatgcgcctgccattgagatgaatccagaccaggccgccatccttatggcgcatccggtaggaaacatccagaacctctccgctggacaaagcggcctctgccgcttccatcacccgttccctgtcctgcccgtatacaatattcagcgcattatccccgatcagtgcttcgtactccgccctcgtatgccccgacagggccataacaccgtcagagaaaaatgtaggaataaaacggtgattctccacgcgataactggcaatccccccgggaatcgagttaatcaggtgctgcatctccagctgggcctctttcagctcagaaatattatggaacacgcacaacagcagaggacacccgtcctcttccccgctccattttacctggacccgcacccagactatatgcccgtcacggtgctgtttgcggaattcaaattctgccgtctcgtgagtacgaataacctgttctgccttttggaccaccatgccggtgtcttccctgtagataagttctgccgcatcgcccttgctcaattcatagtattcgtctaccgtatagcctgacaactcaggcacgccgtctgaaaaatagactgtctcgaatctgtccgataccttatagatggcaactccgcccgggatcgcattgataatatccaccagccgcagagcaagaggagtatcactggtcatggctgcactgcccttttcagggccccccgcagctcatccgccctttcgaattcgcttttaatttcctgatataaatcagcatacgctgcctcttccttgcagatgcggagaggttctacgatagcgcataccttatcgaacagcggggtcagccccatattccctgcaacacctttcagcgtgtgtgccgcctcaaacgcgccttttaggtcattgccctccagcgcggtatgtaatctgctgatactatcatcctcaaaaaacttgtcaagaaacttcatgtacatctcttcattattgataaaacgtgccatagtgatcccatagtctcctccataggcctcgaatatctctttaaatccgctcatcatccccatgcctcctttctgattccaatactgcctgctatatttgtatcgctacccacagtcctgagagtcctgtgcattctccctctcctgaataaagtcatataatatctggtacagccgttttggttcgatgggctttgccagatgagcattcattcctgccgctttgcttttctcgatgtcatcatcaaaagcgttggcggtcatcgcaataatcggcacgaactttgcatccttattgctgagatgcctgatatttgtggccgctgtcagtccatccatcagcggcatcctgatatccatgaggatggcattgtaatacccttcttccgatttgctgaacttttccagggcgcgcagcccgttttccgccgtatcaacagcaaaattacggctttccagcagcataaccgccacctctgtattgattgcattgtcttctacaagaagaacacgttttccggcaaaatcataatcggcatctaccgtctgccttgcctcttcttcttttttcccgagggccctggtaaatgcagagaccagggaagacttgaacatgggcttactcatcagaaggttgacgcctgcaagcttcgcctcatgctcaatggcaatccaatcataagcggtcataataataatggtcacttctggccctacaatacggcgtatccgccgggcagtttctataccgtccattcccggcatcttccagtctatcagaatcatatcgtaataccggccctctgcccataatatctccaccctgtcgacagctttccgcccgctgtctacccattccgccttaatcccgatctctttgagtgtggcaacggcaccctcgcacacagccacatcatcatccaccacaagggtttttaaatgagaaaaattataatcctgcttcctttgattatgcctttgcttctcctcctcactgatgccaagcttcacatcgaccataaactctgtgccgatctccttaattgaacgcaccgtgatcctgccgtccatcatgtccactatattcttagagattgccaggcccagcccggttcccccatatagtgcagtggttccggttgattcctgtgaaaacggctcaaatatatggggaaggaattcttcgctcattcccactcccgtatcattaactatgaatcgcactacaacgtcgttctttgtcctttgcctctgttctacggaaaaagtgacccttccgccctctctggtaaacttaatggcattgcttaaaatattaatcagcacctgctgcagcttcatcgcatccccgatataataatcatctaacaccggatcaacaatacactcgtattccacattcttggccgccgcctggccatagcagattgaattgattccgttgataaattcctctgtaggaatcttttcattcttcaaaagcatcttgccgctttcaattctgctcatatccaatatgtcgttaatcagtgacaacagaaatctggatgaaataccgatctttgatatgcagtcttccacctgttcatcatctccgatcgactgtgcggcgattgcactcatcccgatgattgcgttcataggcgtacggatctcatggctcatcctggacaggaaatccgatttggctgcatttgcctgttctgctgcaaccagcgccgctgcaagttcctccttctgtttttgttcctttcgcaccacatctgtgacatctgtgcgggcaaggcatacccgcccaagctctttattgatatagaagacctggaatcttttcgttctgataccgccgtccctatcactcatctccagactaaaagtgtaagcttcctgctgcccgagcatgtcctgcatgtagtcataatccagctgcttcaaatattcctgtgctgccgcctcatccataaaacttccggcggttctccggatcttctcctgaaaatgcaattcctgccaggctggccccataccgctgctttcaaaggtgagccccctgaatatatcttttctgatatcaatctccacaatgacatcataatccagagacgcaatcttatgaagcagctgttctttgagcttttgctccgttatatcaaatgtatagaaaaagacaatgacatctcccgtctccggattcagataggagcggaaattggtgcttgcccagaacaaacttttatcgctgcggcggcgcaaatattcaaaatggtagtcaacattgccggcagaatagtcttccagaaccttctccctgtccagcacgctgagtatctgttcccggtctggcgcttcaacagcagaggctgccagattgaaaatactctcctgatacgtggcgccgacatgggatatcgccgcgttgggatctgtcatgtaattttccaatacattcttagaaatattaaatctcccctgcgtactcccttccgaagaggagagttcggcaaaatactccagttctttctcgtaaagctcccgcacacggctctgcagctgcttttcctccgtgatgtcaacaaaaacgcagtaaaaatactgttccccggtttcttccttgagcatttgtgccttcagagaaacccactttacttccccgcctttgcatatcacccggttgtcattgttgatcgtattcccgtccgccagtccggcccccagctttcccctcaaggcatccacatcctccggatggatcaccgagaaaaaacggtttcctatagcttcaaattcttttctggtataatttaaaaattcaaaaaaaccatcgtttgcgtctataatcgaaaaacatgtatcatacctgcatcgaaataccgcaccgggcacattattgtatatatgcatcacttcgtcctgtgcctttttccgtgccgtaatatcaatacaaacggaggtaatggctggcctgccattctcgtctttcatctgccgtcctatatcatgtacccatatataggaaccgtctttccgcttcatacggtattcaaccacatattctcctctacaggctagctgctgctctacttcctcgtctatcctctgcctgtcgtccggatgcatgcagttcgtgatcaggcccccgatatcttttacgaattcggcttcctccccataacccagatattccagcatcctgcggttaataaaataaaaaggaaagccgggttctatataaccgcccatcatccctccggcgatggactcattcagcagatcattgcgctgtttcattacattttccacgacgagagtctgcggataatgctctccgtcctgctggctgcttcccggttccgccgcgtggaaacagaagatctgccacttcccgcccgtacattttaaagtaaagaaaaaccggaggtgccacatatacatggaattgatcagagtcaggtccgcagcctgcgaaaagatgccggccgccagatactgctcatgaatgaccgaaaaatccatatgaaaaggttccggaatctcacttatgtcctgcctcagatactccgtcatcatttcctttccctgggctgtttccccgattccggtaccgacaaattttatatcctccgctaaaaaagaaagcgttttttccagattccgctcctgaaaccatgctctgcagaaaagctgcaccgtctgccgttcatcaattgtaattgccatacttgtcctctctctttccgctaaatgcagtattgttatataatatatcagcgctgctgcattctctcaaaagagctttgaattcttcgcagggcatcggttttgcaaaataatatccctgcacgtagtcacaacctatctggcggagccgctcgagctgttccccggtctccaccccttctgccactacatccaggtgcatccagcgggccagatcaatgataaagcgcagaatcccctggctgttaggcttggcggtctcgctccggataaacttcatatccagctttaagatatcaatcggcatttcatttaacatattcagcgaggaatatccgctgccaaaatcgtccatttcaataacaaatcccatatcccgcaaacggctgaccgtatctatgatctgtttcggattctctgtataggcgctttccgtaatctccagatgcagccgggaggctgggagctgataatttttaaccgtttccctgagaatctcggacaggtctgcattgtatatatcggcccgggatacattaacagaaactgagacccgcggcagcccctccagatcccattctttcatgctgctgcataccttgtcccacacaaactgatccagctttgtaataaatccgttctgctcgaaaaggggaataaactcagccggtgactgaagcccccattccggatgcttccacctcaccagcgcctctgctccggccagcttttcatccgatatccggtacttaggctggaaatatacctggaactgctgctgctccagtgcagactccatacagtctgtaaccgcctgtttcttcagtatcatattgcggagcatatcatcatattccgcaaaatatttaccgtattggcctttaatactgctggccgccaacagcgccctgtcacacatctgttccacggagatggttcggtcaacgatcgtataaacgccccatttcatcgtaatattcctaatatccgcctcttcattcacctgctcaattgcttccataaacatctcatccgtatagtctgtacgtttttccagcagacaagcgaaccggtctgaattcagacggccgcagatgcctctgtccgccgttttccggctgtacatgtctgccaccgcacagagcaggcggtctccggtcggtacaccgaacacagcattgatcagtttaaaattttcgatatcggaacagacaatatcatattctatatccggatttcttagaagtatatcttttaccatctgataaaaaaattctttgctgtacagccccgtcagcctgtcatactgaatcacgttaatcatggccgccgtctcccgcagattgatgatgttggctaccctgtgcaggataatctgaggtttgtagggcttggcaacaaagtcagcggcgccgtgggacaatgccgccacctcgtcggactctccgtcgttctgggtcgctacgatgacagggatagcgcagaatgccggttccgctttcataatagagagaaatgtgtaaccgtccatcaccggcataacaatatccagaagaatcagtgaaattacttccccgtattgctttaaaatatctaaagctgcctgcccgttctcggcctccagaacatcatattccgaagaaagaatctggcaaagcagctctctgttcagttcattgtcttccacaactagaatttttttctttgaaaacataatttccatccttctgtaaaaagttattcttacaatgtctattgcaagtgctcctactcttcgtatatttgcaggtatttctattttccgtatattagagtatgcaaaacatgaaacaggcggttcacatccagaggctttgcaagaaaatcgttcattcctgactctcttgctgcatcaacatcttcctggaaggtatttgcagtcatagccacaatcgggatagagtcagcgtcctggcgacggagggctcggatagcccgtgtggcgtccagtccgttcatttccggcatctgcacatccatcagtatagcctggaactcccctggttcactttctttaaaccgttctaccgccagcacaccgttttgcacccggcatacgacggctccctgcattttcagcaaatcttctgcgatctccgcgttcaggtcattgtcttcagccatcaggatatgggtccctgccagtatttggccttcctgcttatcttcctcctctgttttcctctcacagattggaagcgtaactgtaaagtagaattcactccccttccctaactggctgttaacctgcagctccccgcccatcaatcggacgatattgctgctgatcgccagccccagcccagtgccctgacttctcgatgtattgctgccgagttgttcaaaggatttaaaaatccgctcttgatcctccggacggatacccgtaccattatctattactcggaaggtaaatacagcctcctgtccaccggtttctgtttcgatcgtacgaagcataaccctgccgcctgccggggtgaacttaaaagcattggaaagaagatttaccagtacctggcgcaaccgcacggcatctcccattagactgctgtgggagatctctgtttctaaggaaaaggaaagcctgtaacgttcagcctcgccagccatcatgctctgcaggtcgtgaagcatctgctccaggtaaaagggttcgcgtgcaatggaaagcatgccgttctcgatgcggctcatgtccaatatatcgttgataaggctgagcatatactgtgaggaggtacgaagcttagacaggtttttacgtgcaccatcagggaccccctccatcatactagtcagatctgccagccccactaccgcattcattggggtgcggatctcatggctcatgcgtgaaagaaattcacctttggcacggctggacgcctccgccttttccaaattgctccgcatcgcagccgccttcatacgggaacggaagatcagaaccaccgcagctacgatgaacaaaaggattccccccagtaccgccgcaaacaaaaacgggttggcataaacaaaattaaccagtgaaaactgattggtgccaatggaaaccatgtttcggttgaggagatcatccttttcatcagcatcaagactgttgatggccttgttcagtatagtaagaagcgtaggatccactggacgcgccagcgcaaaatccacactgctgttatcattgaccagggtcaccggaactaccttattgaaatagctccgctgaatttcctgctcgatgcggttggaaagcccatagcaaaaatcgatttcgctccggtcaaccgcagcaagggcctcttctatgtcagaataggttctgacttccgacacgggtatacttttggggagctgccgcccctcaacaatgccgcctaccagatcatcgtctggatagttcgatgccttgttgcgtacaataatgttgtttaagctggcatagggggctgaaattgccaatccctgttcagccgcattttcttccgaatcaaggtaaaaacctaacatatctgcccgtctctccttcaccatctggatagcttccagataactctgggcgtacacataggtgaatgtaagaccgctataaccttcgatctcctgcagaatatcaggaaccactccttcatgtgcgttttctgccgaggtcttacagaatagagggtgccagccctccggtacagccactgttaccactttcttctccttaacataagacagctcgtcttcgtcaagcaggatatccgccgttagattcgtaaaatttgcattaaatcgttccgtgccaaaattaggattcgatgcgctgattagcgccagtgacatatttaacccatccagaacctcctggtttcctggtgtggtaacaatatagtatggctgggaatcataggacgccacaatacggaaatctgtgccgcgctcagtaaaattgcccaacaacagatctacctctccttcagccaaatatgtataaagattccccgccgccgataactgatcataggaatattcctttaagcggcagttcagattgttagtggacaaaaattctttcaaacggcggatagattcctgtgcattaacatagacaccgatgactttgccattcatgctctccagatcattagtccggatgctcccgtcgtccctgcgggccagaagggcagatctgccgtaccccatattgtaatccggataggcataatgctcctctaagccaggcatgtaatagctgccgcccatcaggtcgaattcgccatgatcaaagcgctccagcagttcatcactgctgtcaacatcaatgtactcgtactcccagttcgtatattttgcgatttcgttgaggtaatcaaccaccaggccgtgacgggttccatcctccgaattctcactcattccctttacttggggaaaggccacccgaagtacgcgaggagtcttttctgcagactttaccggaatacaaaacatgattgtcagaagtaccgtcatcaaaatcgcagcaatccgcttcctagatttgccctgagatcttttacatatttccatatccttgtaccccttatttctccaaattgcctgatcatgtgagatgctgcagaccgtcatttcaatcattacagatctcaggcagagtgccaagaggtaacggtatgaattcagcttttccgcatcctaatttatatatctatatttagtagtatagcaaaaacagcctaaaatatcaatagaacgtcaacgaataggaagacggtgtcaaagcctcaggcactggctggatttgaagtcattaaaaacccacaaaagcgtatccggccatgcttatgtgggttttatctataatgaaagaccaagatcctctgtctttctattgattgtttcgatttttcatttcttcagggttctagcaggtggcaggctgctttatgtccgcccccgcagtccttccaagccggcgcctgctctctgcagatgtccatacaatgtctgcatcttgtatggaatttacagcctgatggcggctgatcggctgacggaacatctccttccagtatgatcctgcctcctttacggtcaggatccggcctcggtacagcgctcaaaagcgcctttgtatatggatgcaggggattcctaaataattctttcttaggcgcaacctctaccatagaaccaaggtacatcacccctacctcgtccgaaatatgttctaccactgacaggtcgtgtgaaataaacaaatatgaaagctgctgctccctttgcagcttcttcatgagattaatgacctgcgcctggattgaaacatccagtgcagataccggttcatcacatataataagatccggattcagcgccagcgcccttgcaacgcagatacgctgtctctgcccgcctgaaaattcatgaggaaagcgttcaatatattcccgggaaaggccgcatttttccatagtctcctcaacataactgcgcagttcattgccaggtaccaggtgatgttcccttaccgcttccccaatcaattcaaacacattcatcctgggatccagcgaggaatatggatcctggaaaatcatctggatctttgtgcgcatcttctttaactctttctgatccaataaaaacagatccctgccaaacagttttgcttctcccgccgtcggttccgtcaagcgcaggattgttttgccgattgtcgtcttgccacagcctgattctcccaccaggccaaaagtctttcctttttctattgtaaagctgacatcatccactgctttcacaagccctgcgcttttgccaaataccccttttttcattgtgtaatacgttttcaagtgattgacttccaataccgtattgctcataccttatccctcctaaccggccgattctccgctgtcaaaacagctgaccaggtgtgtctcacttaattttactacgtccggatatgactcccggcaacgctcctgacaattgtagcagcgattctggaaataacatccgggcggcagttccagcggattcgggacgcttcccggtatggcatagagctcttctgtctcctcgttcagcacgggccttgaccgcagcagcccaaccgtgtaaggatgtttgggatgatggaatatttcgctcgctgtccccgattctacaatccttcctgcgtacatgacaaccacaaagtctgccatctcagccaccacgcccagatcatgcgtaatcagcatgatcgaagcgctgatctcttgtttcagttcccgcagaagatccaggatctgcgcctggatcgtaacatcaagcgctgtcgtcggctcatctgcgataatcagctgtggattcccaatcaacgccattgcaatgatcacacgctggcgcatccctccggataattcatgaggataattatcataaacattttctcttgtgatgcctactctcttcagaatctccagaattttcacttttgcttccttcttggagatacctggctgatgggtgcgtacgcattcttccatctggtctcctattgtatagaccggattcaggctggtcatcggttcctgaaaaatcatggaaatatcattgtctttcccgccgggatatccaacgtcactccgttcactgctcttacggttccgcgatcagtataaaagcaggtacacaactgttcaatctccagaatattctcctgtgagttcatggtcgtcaaatattctgattccggcacattttttctcttttttttcttatagtattctttatatttctgcttatttccatccttcatacttatcgctccaaattctgatatccagtcttcagcattttttttaataacaataactcttcatcgactacacggtcagttccatcggcctccgcaaattcatccagtatatattgcagtgaattcatcacaaaggccaccatccgtttttcccgttccgtatattccgtctttgtcccatactcttctacttctcccaaaaaccgttcaaaaagctggttgttatttgttctcagataataatgtttccgcttatccagggagcacttttcaaactgctcccaaaaggccttctgaagcggctccatttccagaatttcttccgtcttcacatcccggttcagttgttttcccaatgcctcctgctgttctaaaaacttctgaaacatataatctgtaatataaacaaacaactctgtctttgaatcaaaatagcagtaaaatgatccgattgagatattcgcctttctcacaatctccctgacatttgcatcatgataggaatgcgtggagaattcctccactgccgcttttagaaatatttcccgcttttcatctgcaagattaaaaaaagtcatttttggcattttttgctccttttaccgtttggatctcggatccagcgcgtctctcagtccatcacccagcaagttcatagccaatgccgacagaatgattgcgattccaggaaatacgatcatgtaaggaaacgttctcatataggcgcgcccttcattcagcatggctccccattccggtgacggcggctgtatgccaagtcccagaaagctcaggcctgcaattgaaagaattgtcccggccactgtcatggctccctccacgatgataattcccatcgcattgggcatcacatgcctgactgcaatcttccatgtactgaatccggacgcctttgccgcactgatataatcctggtttacaatggacagcaccgctgcacgcaccactcttgtaaatccgactgtcgtgttgatgcaaagcgccaccaccagattacggagtccgggtcctaacgccgctaccatagccaatgtcatcagcatggaagggatacacgtaaaaatatccaccaccctcatgattaaattatccagtttcccgccgagcagggctgacagggaacctataaatccgcctagtgctgcggaaataatcacaaccagaaatcctacccctattgacacccttgccccatagatcatgcgcgcgaaaatatctcttcccagatgatccgttcccagccagtgttctccgctcggagcctgaagccggttcacggtatcctgtttaataaccatatcataatcgcagattacgcctgcaaagactgccagaagcacaaagatcagtatcacaatcaatccggtcatggccgccttatttctgcgcagacaacgccagacgtctaaaaagcggtccgtcttacgtttccatttttgctgaatctccatcgttttccccgcctcctctattttctaagatatacattgcgaattcttgggtcaatataagccataataatatcagccagcaatacaagcatacagtatatcaatgccaggaaaatagtggccgccataacaacagggacatctttctgcctgatgcctgtcaaaatcagattgccaatcccaggtactgaaaatacattctcaattaacacgagtccgccaagagacaaaccaaaggtagtaatcaatgtcactaagatcggaagcagcgcattcttaaatgcatgtttccagatcaccttccactccggcaggcccttggccctcgcggtccggatgtagtcctgctgaattgtttccagcatggaggttctggtcagcctggaggtaattgcggcctgaggcagtgcaataacagcgatgggcatgacgaaattccgccaggtatcgattccgctgggcggaagcatgtgcagctgcaaagaaaacagaagaatcatcataagcgcaagccagaactgcggcaccgccgcaaaaaacatcgcaaccacagtacttcccacgtcaactgccgagtactgtctgaccgcagaataaatcccgatcggtattccgatcagatatgcaataatggttccccacactgccagccttaaagaatgcggaaatgtagctacaatctccgtgataaccggcctctgtgaattataggaaatcccaaagtcgccatgaagcgcgccccctataaaattgaaaaaccggacgaaaaaactctggtccacgcccagctgatggttgagcttagcgacttcttccgccgtagcattcatacctagaattaatcttcccggatcacccggtgtcagagataatataaaaaatacgataaatgtgactcccagcgtaatcgggatcaccaaaagacatcttttaataatatattttttcatgctgtttctccccacatttctaaaatagggtgtatccttatagcccttaaggcggatttggattccacggatttcatattaaaatagagtttcgtttgcgaagctcgcgccttcggcggccgcatcgcgacatctgcctcttacgccgcagtgcacatcccgcccagaggaatttcctatatcataaaaaagaaggctgcctcgcagggccgccttctcaactttcaacccgttcttattcaccccatctgaaatccttgaagcaatagaacattccgtttggatcaatatatgtatcctgcagaccctgacggtaaacgatattagatgtcaacgttaccaatggaatctcatttgccgatgccataatatcctttaaaagagagcaagtctcttcagttttcttatctgaatctacttcataacggattgcatccagtctttcattataaatatcgctgtccggtgaggatgcactccatgtattatccggccaataataactgttgtaaagtccctcgcttaagtccggcgtgatctcggaaccactctggtagatagcctcgaagttcccgttcagccagtcctgagaatgcgcccccatttccagcgtctcaatcttgacctctattccgatctgattcagattatccataataatctgcggaacaacatcgccataggtatcggatgttttgattgtaaaggaaacaccgccatccggatatcctgcttctttcataagctcttttgccttgtccaaatcaagcggatatgtatagtctttcccgtcatagtacaggaaatcttcataagacccggtagctattgtaccggtaccttcaaatgcggatgtattaatggcttctctgtcaattgcgcaggcaatcgcttgtctgagtttctcgttttcaagaacgccattgcggacattcaataccaacgatgcggtactatgcgatggtgcactctgaagcactaattcctcgttcttttcaatcaacggtaaatccgctgctgaggcgttgatcataaaatcattatcaccattttccaatgccacaagggccgttgcggaatccgtaatgatattgaaattgagatttttaattcctgccttcttgccattataatcttcgaaggcttcgaaactgatcttgcttccttttacccactcttttaacttatatgctccggtacctaccggctcgataaaggcatcatcgcccttttcctctacgtaagacttgcagacaatcccaagtcccggtgaactcaggcttgagaaaatactttcacaaggatatttcaactttaattctaccgtattgtcatctaccgcagtccatgactcaatcttaggtttaaaggaattggaaggagatttttctgaattcatctcaaagctgtaaataacgtcttcactcgtacatgtctctccattatggaactttgcaccctcgcgcaggtggaaggttatcgtcttcttgtcatcgctgacatcccatgattcggcaagtcctgggacaggctccccctccttcatatataccagacgctcataaatctgataaaccgacataatatccgaataagaattcgtcacataaggactaaactgatttgcatcatcccctacaatgacattcaatgtgtcctttgctgcatcgccgcccgttgacttcgaagcggatttgtcttcgccgcctcctccacagccggaaagcatcccgatgcacagcatgactgtcatcactaccgctgctgcctttttcatgaattttcctccttttgatcgaacagtgtgcatctcaaagagtatgaacctgttcatttttacatagtaatataatacacctatgctttaatgttgtaaagccgcattttagattctcagaggaaattttcagacattctggcatattttaacacagttaagcaagaatttaaatgattggacaacatgattctatcgcagcagaggaagattccccgttaatttactgaccagttttttctctccacaaatcccaatcccataatagttaaaatcagtctcttccacagaggccgctttttgaatataatcttcatacacattgcagctctgcgccacatcggaaaaatccaccacggtcaggccttcaaattccggttcaaaaagtcgttcccgtaactttttgattttctctttatccgctttcaggaccggaaccggtatctgaatgatccccaaatgagaactgccgcttttatccgtaactaccggtccaattgtttccggaatatgctttccaagagtaatccccatgataccggcagtatttgctataacgccgaggggcagagcctcatcaatcaccatcacacatttattagagttctgttccatatcttttttctcctttaccttctcctgattcaaatgccggcgtatcggtaaaaatccgctgatactgctttggcgtcaacccaataaattctttaaaataattggtaaaatggctttggtcggtaaatccagtcatccccgcaacgtctattggcacaatcccctgctccagcagcctctttgccctctctatccggatcgtctgcagataccggtagggggatacacctacttgtttcgcgaaagaacgcagcagatacgattttcccgctccaatcatggaagccagatcgtccagtgtaatattttcagccaggtgctgttccatgtaactgcaaagcattttcgtctgcttatcaggttctgtatctccaaccttttcaagcggaaccgcatactcctgcagaatctgttctatcagataaaagagggcttcttccttcttaagctttggcgaatccataaggattgcatcatacacatctgctacggatggggcaatttcgctttggataatgacattccgggtaaaatatggcgtgtactcctttccggtaatttctttgacaatgcctgtcatgacatcggcgttgatattcacagcgcggtaatctaacagttccccgcctacgggggcacaataatggttgtccctcggattaaataagaccaggtctcccgcgctcaaatcgtactcctgtcccttgcaccaaaggtggcgctttccgccctcaataaagccaattacgtaaaattcatgaaaatgattcggaaacttttgtacgatcccgcttaactgatatgcctctattcccagatcacggtcatagtagatatgacgctgctcctgctttttgatcatgttttgtttacctcctaaatattggattagatgattataacatgtaggatttgttttttcttgtataatatgacacgatgaatacaagagaggggctgccttcacgacgccccccttttcatcataatgcagagttctcattcaggttcctctttctacaaacccgtgatatccctattgaaaatacgatttcaaccatctgatagattacattcaggaagacaaacagcagcagtattgcgtttacatgaatcccaaaaggcatatagtcctgaattgcaatcgacaatgctttctgaacagctctcgcagtcaaaatgcctggaataagcgttatcataaaagcagcccacacaatgggacggtaaacataaacctgcatttttcggatttccttctgactgtatcccaaaagacttaagatggacatatccctctgattgtcctggaaattgagatacagcgcaaggaacagcagtatacatcctataatcgcgccaatcacctggtttatgactgcactcgttttattggaggtagcatcccgctgaagcatctgcttcacctgttctttgctgattgccgtaccatcttctgacaccgggctcatgctccatactccattgtagctccctcgggcgccttaataacctccgacaatgcggatgcattcacatagatcgtttttaactgtgcgttttcagcaatcccgcgaacactttttttgatctcatgtccgccggtccctatgacagaatcacagaaaagatacggcagtgcatcttccggaagtgcttcgtttttgtattgccatattcccgtctacggagaacatgacaaagaaaaaggaaagtgatgtaaggccggtcaatagaaagagaaataggataaagactttattctgcccgacttgtttcgccagctgtttatataatagacccatatcttacccccataccatgtttctggctgctattggatgttcattcagcacatcactttatacgatgccatttttcatcgtaataacccggtcggccgtcctggcaatctgcggattatgcgtcgtgaagagaatggtcatgccaaaagtcgtctgcagattatgcgaaagttccaccataattttgctgttctcctcatcaagggaacctgttgcctcgtcacagaaaaggagccgcgggcttttgatcacagcccgcgcgatagaggttctctgctgctgtcccccggagagctcagcaggaaacttatgcagcaaatcttccaactggacaccaggcggtcaaaggaaagggaaggcttttgggggcttataccaatttttatattttcttgcaccgtcaggttatccaatagcagatagtcctgaaagacatttccaacatccctgcgcttccatccggcaagctgtttttcagtatagtccgtaatgacggcatctccgcaccttacgcttccgcctgttggctttatcagcccggaaagaatatttaacagggtgcttttcccggaaccgctggggcccaggatggcggtgaatgtattttcatggattgtgagggtaattccttttatcacatgctcttttccaaaatctttcgtcagattctccgctttcataattgtgtccaagtatatgtttcattgccgtttctggattcggttttttatagtccttttggcactttcctattcattctgacctcttcttttgtccggtagagatctgtaagatagccaaccagataaatcacgaaaaccataacgactaatacccatacaggaatactccgataccaatggaatacggcgcccaataaaagtgtcacaaacaagggataactaacatccagcataattccaaaaacggattttggatatccagcctgtacggctgtttaacagaggccgtacaaaatccagcacatggatatttagaacgcatgatttactaatctgaacaaacccaaccggggccagaatttctaataattaatacaggcggatgtctgtacggtaaaccccgttttcacagtaacaaaagtatgcttatccacactttcgaggtagtaaatatctgaggcattgagcagcttctcattcccgtcagcggtgcatctgatttgggtgtctgctgaccggatcagcgaaatgagcctcgttacatcctggttcattttcggatattttatggaaacctcgatttctttctgggttgtgtcttgttccagcttgagtaacaatgtagtacctcctgctatttatggatattagatccggagtcatgggacgcttattttgtgaatttcatatcatttctgatcattcttctttttaatcacacacgtataaaagaggcgcctttaagattccggacggttctaactgatattcgcaggcccagcacgttccttccgttctccatgcatttggaccataccatcgctccgtttcattgcaattatgaagcgtaccaaaggtatttatacgatttccaaaaacagtgagcttcagtacatgctccccttcctcaatctccgtcttcacttgatatggcgcataggcgactgcctgtttcctgccttcgtcaatttgaacttttaaaagaggcgctctgaatctggatacctcaacaaggattttctgtcttttctccaattgaaatggtatatggtattgtatgttcccgccataaaacggaagtccctgacgagttatatccgcatatgccagttttcttacaggcgctgtcaggattgattccgcgccagcagtttgtactccaaaatcccctagcagaaacatcgcctcaatattttcctttttcctataagggatttttacgatcagttcgttttcaccccggctgattatacctaattccctgcatatgatgtcctggtccacataccatccattcaccctgctctgaaccatgcttccattgagccaaacttctgcctcccgattctccaaggccagttttgctcccgctatatctgccattgataaaaacttaaacctcaaaaacaaccagtgtttcagcggttctgcatcctgatccagccaaggctgtgcaaaggcttccatacgaagggggtaacccagaaccttccggaacttattgtcgatacgcagtatttcttcttttttctgccatggtccctggtcgaaaatatactccgcctgatcgaacaccagtacattcggttccgataaaacaaccggcactttttctggaatttctattcgtttcagagcttccgttttttccctttccggtatcaccggcatcaattttttttgatattccacagcttctgcaggacaaagacggagcagaaggctgtcatgattatacatttcttttcggatgatcgttttcccatcataatactctaatgctaattctgtttttgtgccatccaggggattataacatataaccctgtatactccttgtattgtaatggtattattttcacgcactggtacatccggattttccattttgtttacatgtgcaaggaaaattattttttcttcattgtcctcccgcatctgataaatcaaattatccgctctcatgccattttcattttttacatctaacactcttctattctctaatttatttaaaagcttagtgcgcgtaaatggaacgtattcacatacttttacaaaatcctccatttcttttgaatattttccatccagatacttcggagtgtttcctgtgaataaaacgctgccaccctttttgtaaaatgctttcagacgcttgaacgtagtagttctcaatgtctcacaattcggtaccagaattgcctcatacctcatgtctcccaccgggaatatttcgccgtttatttgttctatgctgttttggtttggtaatagcgattcacagataaagtcaaaatccagaaaaccatagagcagccactctatcactttttcaaaattctgctccatctcctttcgtattccacttgttttttcctcacatccccagtaaagccaatacgattcaatgggatggatcacaccgatctttacgacagcctttccccttgtcagtagtgtattgattcttgcaaaataatcttccacataataatactctctgtaccaaggtgactggtaaccaatggccgccggataatcccgctttgcttcgcctcccatagaagtccatgttaaatgatggacacgcacggttacacccagggccgcctgccagtctccctgcagtttatgtccccgaaagtcaaaatcccagtttgttacaccatacatttcacttaacacacccggacagccaaactggcgggctgcactctgggcctgtttggcagttgataactcccgcctgtcacaaagcatatctattcccgggagctgaaatgctctgtatgacctcatggcttctcccagtgctgctgtctgtgattcaagagtaggctcatccatcatatgtcctgtcagcattaacccgttttgtctgcaccagttccccagtgtgtctgcaaaagccgatacaaaccgttcacagacatgatcatgatactgataacggatttcagaaacacagttttcacctttttcccaaaataattccggcagataagacagaaaatcatgcccatacgcttccgtaaacgtctcgtcaaaatcatctgtgtaaggaattatgacttccgttttatcttcagcataacataaccttgttttatggcaaaactgcggttcatctgtaaagatagcaggaatagactttccaaattcagcgcccagtttttccttatacttttcatgtgtaacttcaataaaacattgtatagcctttttatccagtgtattaacatatgcctggttattaaaccatggattctccccggagatttctaaatatgcaaaccattcatcatagccgctctgtggtacttctgcctctgacagtctgtgataatctataagccatccatccctgatcagtacttcatagcgggataagagcctgcgcttatcgcttctgacagcctgacctgtagaggtaactttacttccggtctgatttttctccagacggcagggagaaaataccagaaaacggatgcggtatttttcatttttagtcaccattccgcctcccgatccagaaggccagcgatcctcatcatataaccaggtcagcatcttttctttttttaattttttattagaatcctcaaccagatcaaggaattcctctcccatatagggattgtcaagtcctgtgcggcagtgaatatgcccgccgcccatccccattgtctttaaggtatctatcatcatgctgattttttctttcgtcatatagcagttccatgcccagaagggcgtacctctgtattcactgtccggattctggaactgcgcttcctgaaaaggaaattcatttttaggatatagcatcattctcccccttgtttaaactgtttttatcctgcactgctttttctatgtactctgacgggctgattcccgtaacagtgcggaagattctgctaaagtaaaactgatcagaaaacccaaccattgcagctgcatctttgataaacagctccggattgtcggacataatttcctttgctttttcaatacggaaagaattcagaactctgttaaagctctgctcacaatacttgcggaataaacggctcagatatgtctgggagattccaaagacatggctgatgctttgcggagaaagcgaatccgttaaattttctttcatatattttaaaatcttttcgaaaaattccggcgtgtcaatttttattcttctggcctcttcctcgaagttctcgctgaaaatctgaagaatattgtctgaaagctcctgcatatccgatgcaaaataaaaggcttcatctaaaaagtattcatacgtgtctacagattcccatagcatatttcgtctgcgaaacaaaccgaacaactctctcaccttttcttcaacccataactgagttcgttcctcctgctcccattttgcaaaacagcctttaacttcctcgcgtatctgcctccggtttccttctttcacaagtatattcattctctccagcccactattatatccctgtttttgttgttttctttcctgtttatcattcacaggcacaacctgatcttttccaattaccagggaggcatccagcgtctgatacagccttcttactgcatccggtagttctttggggttcagcggatcttccatcagtaccagggtataatagtcggctgttcttttctctttttctgccatatgagtcatcagccgaaagaagcttccggaaaaaagaaaatcctttggaagtaaataaagtgcttccctttcgtcccttccatatacggccatctgctcatcttttactgaaaatatttctgtttcttttgaattcacaaatctgcgtggaagaccatttttccgcaaaagtgctgcataatactcttcttttgaaaaaatacggtaaaaatccttttgattttccatgtcggtctttcccatgcacatctcccgcaggattttattccgtttactataatacaattcatccagacagccctgcataacccgcatactggcctgaaaagcggatggcctgaccggctttaatatatagtcacataccccggtctgaatcgccgctcttgcatattcaaactcctgatagccgctgataatcaaagtcatgatctgcggatacctgtcttttacttttcgtgccagagttacaccatccataatcggcatctttacatcggtaatcagcacatcggtgtctgtattttccagcaggtccagagcgccctgcccattatccgccgttccgacaacctcaaattccggacattttagttcgatcaaagtacaaatatggcgaagtgccgcgggttcgtcttctgttacaattactcggtacatctctgcctcccttgttcgggatctccctctttctgtatatggttcctgggacccccaattaaaacttctgccccctttttccaatttcccagcttaaaaacggttttttctgcatataacagatatagtctcgcataagtattgacaagacccattccgcctatttttaattcgatatactgtctgttgacgcttaatgccttctgcacattctccatcttttctttcaatgcgctcaaaacatcctgatgaaagccgtctccattatctctgatccttacataccagaaatcattttcttcccagccctcaacgcagatgcgcatcacttcagtgctgttttcaaacccatgggaaacgctgttttccacaaactgctgcagaatcatcttaggaagcatctgctgtgatatcctgtcatcaatctcgatctgataggagagcttatgctcatatcgatactttaataatgaaaagtatttttgaagataatttttttcgctgatgatatccgcatatctttcatttgtattcgtggtataccggagcattccggctaaatcatcgcaaatatcacaaatgacctcgtcatcgtcctgaatcccgcggtttgaaattatattcaaaacgttatataaaaagtgcggatttacctgtgcctgtaaaacatccagctgcgcctgcagctgcagcgttgataaccgtgcctcgcggattatggattgatttaattgttctttcatttctttatatatctggctcagttccttgaattcgttctctgctgccggaatattctctgctttttccagatgtgcatttcttacaaatatacggagctgctctattggctttgtaagctttttggacgtaaaaataatataaaagaacgaaaagcacaaaataatagctatcataagtgcagtaataatatagataccttccattttttcggccagaattttaacatcttctgttacaattattcttgcacccaattctttattatatattcctgccgcaagtatcttcgtaccattcaccgactcgtagctgccgggagtgatctgtttctcctttgtaaactgcttataaaatgctttgtcttcatttcctgattgaaataaaatattaccgttttcctgcagcaggcagatatttaccgttttgtctgaaacctggaatatctgttccagatctgcctctgttttctgcacttcaataaaccctatgtcctgtccctggatttttacaatccctgaaaacacctgcacttgttttgcttttccccagggatcctcgtgaagcccctgtatatataattcaccccggttttcacccatattcttgtatgcgtcaagctggctgatatccagaccgggcttaatttcccggcttccccaattattactggctattacgtcgccatgtttattatagtaaatgactctgtaaaatttttgattcagatagtccgtactcatcattgtctggatcttctttttaccttcttgtatgtaattactgttttgaggcgttttttccagatgcgccagcatcagtatcgctgatagggtatcactgtcacttaaaagataatggctaacgtcttccatcgaccgcagcaattctacatactgctgatttaattgtttagccgtgctgctgaggctcatgcattcctgctgtataaaatgggacttactcatggaataataaatgctgcctgttgcaactgcggatacaattccaaaaagcgcatagactaaaaatatttttttctgaaatttcatccgtctctcctttattctactgcccattataacatattcttttccggttatactacacgatgttcagccttattccgcagcccgtttaacctttcactgatccggctaccatgccgtccacaatccgcttattaaagattaaaaacaagattagcattggaatggtaatcaatataacatctgcaaataacagattataggaactggcatactgacccttaaaattgtacagtgtcagctgaattgtagtattctcattccctggcagaaaatagagtggatttgtaaagtcattaaatatggtaaccgcattcagaataatgatcgtagccgttgccggttttaacagcggaaaaatgatggaactgaataatctgattttactgcacccatctatgtagcccgcctcctccaattcgaccggaatggaactcataaagccacggtaaatcataatatcaaatggaatctgcagggcaatctcaatcaaaatcattccaaataaggttttatatatatgcagtccctgcatgatccagatcgttggcagaattgccggtggaatcattagtcccgtcatgataataaagtttacaaaagacatggtgcgtccccgccttctctgaagaacatatccggccatggaacatacgaaaacaagtccgcataaggaaaataccgtcagtaataaactgtttttaaatgctgtcagaatgatgtaattatttgactcgaaaacttccttataattgctccataaaggtttcacaggaagtgccatactaagtaaatttgcctctctcctgtctttcagagaattaactaacataaataaaaatggaaatacaaatacaataacagccgccgccattcccacaatgtcaccaaaaagcaggatcctttttttacgcttcacactattccacctcccttctctgcaaaaatctttgcaatgggaatgccaaaatagcaattaaaatgaacatgatcacgttcccggccgtagacaggccataaaaaccggaagcatactgtttatacacaatagaagccattacatctgttgaaaatcccggtcccccgcctgtcattgtccagattaagtcaaaacatctcagtcctccaatgaaagataatataataacagaattcatagcaggcctgcaaagcggcagtgtaatgagtctgattttctgccatccatttgccccgtctatagctgccgcttcataatatgttttatcaattgaagaaatccctgctatatatatcatagtggcaatcgacagtcccttccatacatctgtcccaatcaccgagtataacgccagatccgcatttcccagccagtcaattccggtgcctccaagaaattcaataaatttattgaaaacccccttcgtaggatgcataaatgctgtaaatgttatccctacagcaatagtacttaccagatttgggaagaaaaccattaaccggattatattttttgtccgaattgcacttgtcagaaaaactgctattaaaaaagccagcacaacctttaagcctgatgtcaaaaccgcgtagatcaatgtgtttataataccaatattcaatgtccgctctgaaaagaacatcttaaaattatccagccctacgaaggtgaatttctcaaaatcccacaccgtcaaactaaaaaaaagagagattaccatgggaataatgaaaaaaaccagaaagattgtcaatgcaggtaccaaaaaccaaagtgaatatatttttttcttgttcatattcccgccctattttgtctgtttttctattcttctgtttatttccagtctaatccaagctgcactgcctgcttcttacaatcttcatcatatgcttttgcggtctcttccggtgttgattgtcctgatccgagctcctggcagagtgcaggacagtttgctcccttcacaggcgataatgcttccatagccaacactgcccgtccttcttctacatatttttgggaatctttaaccgcatcaaacgcatcttccggcagttgataaccattatggaatgggccgtcaggaagaacttttgaaacataggcatcgattgcttcgtctgataaccaccactccataaatgcttttactgcatcgacgttttcactatccttatttccatagagagccgctgctgtaaatatagtcacacctgttttatcttcctcatcacctggataagcaaaaaagccaatatcatttacctgatctccatacaaagtatagatattgcgaagcgccgcacttgtcatgatgtaatgtgctccctctccatttaccagcatatcgcaggcatcgttataatttgttgccagatagtcctcgttataataaggggtcaattcggaaagcttttcccagcttctaactccggcctttgaatctgcatatttaactgttccctgtgtgaatttttccgggaaatcaggttcttcctgaagaagttcataattatctaccagaaacggaacctgtgatgtccagttttctccgaaagagcctataagcgctgtatctcctgcttcttttatcgtatcacaattttccatgaactcatcccaggtcacggggatttgaaggtcatatttctcatagatgcctttgttatacatgactcctccaaaagagctgcttgacaatggaacgccataaagcacgtcatccacactggccgcctgaatgaagttatcatctaatgtcgaagcagcctcagaatccgtcatatcaataaagtattctgccggatttaatgctgccagcatcgcgcctgaagagtatacacaaatatctgccatatctcccgatgccagccgtgttttaacaatgttgttcccttcatctccgctggaacgtgtttccaccactacttctatccccagtttttcctttgcgagctctatcaccgcctcatatcctgcgggttccagaccattctccacctgcatcgttagtttcacgccatcatatggcttgtcccctgttttagtatcagtttccactttagattcttgtttgttttggtcgggtttctcctggccgttacatccgccgagagctcctattgccattattaaaacagcgaatagagcaatgacttttttccttttcatttctgtatcctcctttttttgatatacacatcttaacacttcaccagcgattatttacatggataaatccgcaattaaaaatgtacatattctgtctcaaataagatttctctttcatgtgtcaatttttccatttttaatactaatatttccattgcccataaaacaataaaaacaatttataagatgtgtgactttatttgtaagtaggtcaataacccatatcttaacaaaatgaaaaatcccccagtattgatcttacggggggaaattcagcttttgccatttctgattactgcgttaattatccgggagacttgacgaccacggaagtagctccaacaattcttcttttttcggaaatgaactaaaatctttcattttttccatcacataggttaaataatagtcagcatccacctcaatccgaacattttctggaagacagactgtcacagaaggatatgaaaatttattgtagattcggattattacctgcttattttttctcacatcacgtacattgcatcgccaaaactaaaaaatctgtacccttccctgaccgcctcctcataagccgccagcacatgctccctgcccgccagtgcagacaccagcataatcaaagtagattccggcaggtgaaaattcgtgatcagtccatccagcaccttaaactgataccccggataaataaagatttccgtccagccgctgcacgccttcagccttccatcctcccctgccgcagactctatggttctgcagctggtcgtcccaacgcagatcacgcgttttttctgttcctttgcacggttgatcttatccgcagcatcttcatcgatgagatagaactccgaatgcatatgatgatctgtaacttcctccacctttacaggccggaaagtccccagccccacatggagtgttactctggcaatatccacgcccttttttccgatatcctccagaagctgcggggtaaaatgcagcccggccgtaggcgcagcagcagagccttcatgcacggcatataccgtattataccgctccttatcctgcagctgatgtgtaatataaggcggaagcggcatctgtcccagccggtccagtatttcctcaaagatacctttatactcaaaatgtatcagccggtttccctcgtccactacatccaccacttcacccaccaggataccatccccgaaactgattttcgttcccggttttgcctttctgcccggtttcaccagggtctcccacacatcattttctttccgtttcagcagcagtacctctatctttgcatccgtgcctactttggagccgatcagtctggctggtatcactttggtgtcattgatcaccagacagtcccctgggttcaggtattcgattatgtctttgaaatgccggtgtttcgtctctccggtctctttatccaaaaccagaagtctggaaccggatctgtcctccagcgggtcctgtgcgatcagctcctgcggcagttcataataaaaatcacttgttttcaactttaaatccttctttctgctattcgggaaccgtctgccctgcataggacatcaagacgccgctcccgtatttttctgtcagactgctcaacacctgcatatccgattttggcaggatctcttccgccctgccaaaaaaagaggccagcgccggctctttcatatccggctggtaaaatgtagtgtttccaacctcatactgcatttccacagccagatcctcaaatgtggtgatctcatcgatcaggccgttatccagggcctgctgtgcggaataggggcgtccgtcagccagttctctgaccgctttttcgggcattcccctgccctgggccaccgcgccaacaaatcggtcatattcttcctcaataatatcccggtaaattttcagctgttcctcgtcgggactgctcatgtctttgttgtccccggttgtcacactgtaatacttgatccctagcttctcatacaaaccggacagatcgtagccggacataatcaccccgatggaacccgtcagggttcctttattcgcaccaatccagtccgagggcgcggcaatataataagcggcggaggcgccgtaatggttcatgtatgtccataccggccgtcccgttgtgtctttatattctgcaatcttgtcatagagttccacaccttcgtaggtggttccccccggtgaatccacatccagcagaattccgctgttattagggtcatacatcatggcgtcgatatagtccatcaatgcctgatgctggtagctctgcggctggtcgaacataccggtcctggcctgcggttcgattgtgccgtagacactgacaatccccacatacggctctgttgggagcgtgattgacatattccctcctgtcaatacccactccgaggattcctgcgcagaaggacccgccgtatgaaataaagttctcaccacaagcctggcaaagactgccacaatcaggattgcagccacaacaactgcaacaataatctccgcagtatgatttttctttttcatatgatctgcctttcttctataaatatatagaaagtacaaaatgtgttttaaattcactgcgcccgtctgaaagccccgtcaggcgggacactcagccgggcacatggatgatttaacacaccttactgtctcagttcgattcccatctcctccagcgcgctcagaatcttcttcatggctgctgccacatcagattcttccagggtcttatcctttgcacggaacacgatagaatatgcaattgatttgaaaccaggtttaatctgggctccctcatataagtcaaacagcgcgtaacgctccagataggaaccgcccttcttctcgatgacttcttcgatctgtcctgccaggatattcttcggaaccaccatactaatatcccgggtaaccgcaggatactttgcaattccgttatattttctgtcaaacgtagcatactccagtatctccggcatatcaatcactgccacatatgcacgctctccgatcccgtaatgatcggccacatccggatgtacctcaccgagatagccgacgactcttccctcgtaaataatgtttgcctgacggccgggatgaagatatggcttcccagcattcggatcgtaagtttctttctgtttcatgccgattttctcaaaaaattcttccactacgcccttcatactgaaaaagtcaccgttcccgtacattcccagtgtaaactgcatgcgttcctcgggcagttctgtcaggggaagctgtttcggaagataaatattacccaattcatacagacgtacgtctttgtttctgcggttgtagtttgttgccagcgaggtcagcattccgtttagggatgttgtgcgcatgacactgtagtcctccccgagtgggttcatgatctctactgtatttctgagtacagaatctgccggcagcaataatttatcaaatactttcgggctttcaaaggaataactcatgccctggctgaaaccacagaactctgcaatatctcttgccacttcttccaccttaagcttaaaggagagctttcctgccgttgcttccccgctgggcaaagtcgtcgggatattgtcatatccgtagaacctggcaacttcctctgccagatctgccaggcagaacaaatcatggcggaaggtcggcgcaatcacttcttttgctgcggcatcatattccaagccgattttctcaaaataaccgagcatttccgcttcagttatctctgttcccagcagtgcattgatcttcgcagcgtcaaaaggcactctgaccggttcttttactttcccgtatacgtctacggttccgcccactacttctcctgcgcccatctcttctaccagctggcaggcacggtcaattgcagcttttgcattgttcgggtccaggcccttttcaaacttgccggatgcatccgtacgcagtcctactctcttgctggacttccggatatttaccccgtcaaagcaggcagcctcaaacagcatcgtctgtacatcgtctgtaatcatagagttttctccgcccatgattcccgcgatgccgatctctttctcgccgtcgcagatcatcagcacttctttgtccagctttctttcctgcccgtcaagggtggtaaacttatccccatcctgtgcggtcttaacgacaatctgtcgtcccgaaatggtgtccaggtcataggcatgcatcggctggccgtactcttccattacatagttcgtaatatcgaccagattattgatcggacggattcccacagatgccagccttctctgcatccattccggtgatgggccgattttaatattcttcacaaccctagcacagtaacgcggacaaaggtctgtattttccacgcttaccttaatataatcgttgacatcctcttcgtttcctgtctcttttacaacaggaggatggaattccctgcgaaatgtagccgcagcttctcttgcaatgccaataacgctgtagcagtccactctgtttgatgtcacctcatactcgaaaaccacatcattgaggcccaatgcctccaccgcactggctccaatctccgcatcctccggcagaatatagataccgctttcaggagcatcgggatacatttccttcgtggaacccagctcctcaatggagcacatcatcccgcagctctccacaccgcggagtttgccctttttaatcttgattcctcctggagtctttgaaccgtcatgtcctccggcaacacgcccgccgtccagcacaatcggaaccttatccccctcgcggacattgtccgcaccggtaacaatctgtaacatttggtttcctacattcacctggcagacgattaatttatctgcgtccggatgtctttcaattttatcgatctgtccgatcacaatcttgtccagatccgcatccagcacttcatagccttctacctttgttccggacaatgtcattgcatctgtatactcctgcgcagttacatccagatcaggaacatacgctttaatccatgataatgaagtattcaatcttatttcctctctttctgcttattcatattatccaatatactttccatacccgccggctgttctagaactgtttcaggaaacggatgtcattctcgtacagcagcctcatatcgtcgatttcatattttaacagggcaatacgctccagtcccatgccaaatgcaaagccggaatattcttccgggtcaatgccgcacatttccagaacatgcggatgtaccgccccacagccgagaatctcaatccacccgctgcctttgcagaatctgcatcccttgccgccgcatttgaagcagctcacatccacttcggcgctcggctctgtgaatgggaaatggtgcggacggaatttggtctttgtttccggtccgaataattcttttgcaaatacctccagcgtgccctttaaatcggcgaaggaaatgtttttatcaatgacaagcccctcaacctggtggaaggacggagaatgtgtcgcatccacttcatcagaccggaataccctgcccggtgcaatcatgcggatcggcagtttcccctgttccatcacacgcgcctgtactggagaagtctgggtacgcagcacaatatctttattgatatagaaggtatcctgctcgtcctttgccggatggtcagccggaatattcagcttctcgaaattgtaaagatcatattccacttccgggccttccacaacctcatagcccatacccacgaaaatgttttccacttcttccagggctattgtgttcggatgtctatggccaaccatatttttcttagagggcagtgtcacatcaatgacttccgctttcagcttctcttctctcagaatacgttccatctttgttttggactcttccagcacggcctcaatcgccgctctcgtctcattcacaagctgccctaccttcggcctgtcctctggcgctacatctttcattcccttcaggacagcggtcagctcccccttctttccaaggaatttaacccgcacatcattcaatttctctggaacatccgatgcctgaatctgtgcaatcgcttcttctttgattcgctccaatctctctttcatttggcattctcctttcttagcggacgcagcagcctctcataagctgcgtctcagacagcgcttcacctgtatctctttttaataaaacatcccaaaatcattagggtatcccgcccggagggctttggcgccgccatgcctctttgcggctatataccatatggcggcgtgtgcatcctcccggagggttttatgatataggattttcctatatcataaaaaaactccgtccctgaaagggacgaagttctacactcgcggtaccaccctaattcccgcagtattcctgcaggctcttagctttgtgtaacgtacaacatacggcattctctactattggttcaagaatgcagctatcgtgggaatttcgattgccatctgaactaaagaaaacttgcagccagtgattttctctctctgatagaaaatggttctctactatacacggttatcgcttttttttattctgatatatcttgtgttatatcggatttactttataattgtatcacaaggttttttattgtcaaggattttcttattttctcattctgtccccttttctctcctccaggccttccagcagggcattcagttctccgccaagcaggatgacatacatgcagacatacagccacagcatgatcagtataattgttgtaaggctgccgtacatactggaaaatccggtaaaaatatccagataaacggaaaatataaaggaaattaacagccatccgcaggaagtaaataccgcacccgggagctgctgtttcatagttgtcttggacagattcgtccggttcggaaggtacttatagaccatatcccagaatagagtcagaactaccagagtcagcagggttctgatacgaatcagaaaatccataatcgtcgtcagtaccggcatatgcttatatacaatgatactaatactgttgccgaacacagaaagtgacagagacaatacaatagccagtatgaatataactgtgtaaaaggaagcacgcagcctcagataaaaataatttctggtctcagtattttcataaatcagattcatacccgatgtcatcgcgagcacgcccttccctgcagaccacagagctacgattatggtcactgggatgatcgtgctggactgccggtacacctgatccacgatggaggagatcagcccttccacagacgttggaaacacctgagttactgcagccatcacatcctgccgtgttaccggagtaaactgtaccattgtcagaagcagcagtataataggtattaaagacagcacgaaaaagtatgccgcctgcgccgcatacgcccctgtatggtgtgaacccaatatagaagccagtctattaatttttcgtgtaatgcttttcactcttcccttcatcctgttctcctgcctatcctattaataaacttttcaaatcataccataaaggaggaatttattcaagctcaagagctctgaatcccctatttcacggcattaccctcttttctattagaatcagtataaccgctttcatacccatatatgaagctggacaaagaaaaagacagctgcacgctgacagctgtctttatctttagtaagtttccccaaaatgccggtcctgtattttgactcctagccgcagctaggtgggcaaccgcatctgcttttctgtcttccactgctaatcggaggcttgacatattacagaaatataagaatcccgtttaaagtattgtaggttcaaaataacagggttatcgaacattccaggttttctttaaaagtattataccccatttatctaaaatttacaactgctattaatggctatttttatttcctttttttgtgattatttcttatttcgaaaccgtgcattttatgctgttatatgatatagttaatggtatacttatttcgataaaggagtcttaatttatgaaaatgaatgagttaaagcttgtctatttcagtccaacaggcacaacacgaaaggtcatcatggaagttgcgaggaatattgatctaaaatccgtctcctttgaccttacaatccacaaagagaaaagagcgcctcttcagtttaaaaaagatgattttgttttatttggtattcctgtatacagcggccgcgtgccgaaaacattcctggaatactttgacggcctgaacggggacagcactcctgccgcactggtcgctacatatggatgccgtgaatatgaggatgcgcttctggagctcaaaacagaagtagaaaaccgcggattcaaagtaattggcgccgccgcattccccacagaacattccatcgtacgctccgccggtctcggccgtccgaacaaagcggacatgaaaatcattgcagactatggcattcagctgaaccgccgcatcaagaaggaagaatccttcgatcaatttaacatccaggttcccggtaatacgccatacagaaagtaccgccgtgccccgctctatccaaaagtagacgtaaaccgctgtaccgaatgcggcgcctgtgccaagtcctgtccggcaggtgcaatatcagccgagagccccaaaaagataaacaaaaagaaatgcatcacctgccataagtgcatccgtatctgtaaacaaaaggcgcgttatctcggcaacttaaaaacaaaaatggctttcaaaaaaatgaacaaaatctgccagaacgataaggcggctgaggtattcttgtaagagcaggagggacgcctgacgtggaacgggacggggggattgcggtctttcctgccggctggatgagccagccaagcgggctgtaaggcccggggcttcctgcctgtaaggtcggtttaaaacttccgtatagcggacgactagaagatctaacagagccagaggcgcccagaagggatgttcccttctgggcgcctctggctctattagatcttcttcgttaagcggtcaggattttaaactgaccttacaggcaggaagccccgcgccttacagtccgcttggcgtcctcccatccattcccaagccaaaagcccgcgaactagtttaattcatctactactttctggattgctgcgagtgcatcatccggaagtttatcatatccttctttcgctgtctcgaaagctttgatctcgttgacacggtcgttcatacgagctttcagctgtccgacatattccggatcattcatatccggtacaaagccttcccagtcaagaatctcgatgtctgagaacggtccccatttgtggaagtctgcttttttctctacgattgcttccagaattccaagggtgtcttttggctgtaccttcttgcccatgaaatcgcctgtgttgatgatgtagcagtctacgttcttttcttcaaccaattttttgaacttctcgtagtcgttagccagcggataggttctgaatgggtttgcatatggcactactaccagtttgttcgggtctacgccaggagcaagtctctctgctgtagatctctttgttgcaagtgtagctcccattacggatgcaagggaagctccttttaatttaactaccggcggaatggtaggatctttcatgatccagaagattgcgttaacaggcgcctcgatcttatccacacggtttggtgaccataatttggatttgatagcacgtccgttaccatttcttacgtcttctgttactaactgtacttttccgtcttcgtcaagtgtagcggaacagttctgcgctgtcagcagatacttgttgtcttcgcatcctgtcggataatcctgtgtcttgtcaaagtaggtcggctcgatggcaatagatgcgcatgtatctgtgttgatgataaaagcgtcatcgtgaagaactttgatatcgtactttccgtcatgttttgcatgtgtgattgtagatttaccggatccggacagaccgtatacggatgcaacgtacttgcttccgtcagccaatgtgtattctttttgtccgccatggcaggaagcatatccgttgcggtttgcaatcgcccataccatcgtaagtgttccttttttgtgctctccgaagtatctcataccaaggatgcatgcacagtttgtatctgtgttgaaatagcacagtgtctgaggatcgctcaggcagctgtaatcaactcccggatgagcaaccggtgtccactgcggatcggagaaaatatagatgtctggttcttttccatcgccaactgcaacagattctttatacatctttacataatcatctgacatatactggaagttcagcatccaggaatacatgatgttctcttcgccttccggaatcaggaggtgtaccttaaccatgaattccgggtcaagccctgcatatacagtcgcatgatacagctttttgtaacgagcgctgtaaatagcatccatagccactttgtctaatttgtcgcagtctactccaggttctccagcgatgcgacgtgctgcggcataacgtcctgtaattgcgccgtcgttgaataaaagcaccttagcgtctgcatccagaccaaattcttcacctctatatacgggcatatctgttacgattgttcccggagaattcttcgccagattatatgcctcttttaatgtgttaactggaactacattgtttccataaaatgctgcttcaataatggatcttgtttttgaaaatcctggtttgccctttccaatttcactaattggataatatgcttttgttgacatagtgtaatttcctccttcaaatcgaaatttgttctattatctcatgttcgttataaaaagtcaacagttttattgaaagacatatctgtctcagtttcatttatcaccgctttttcgggtaaaagcatataaaaaagcgcgaaaatgcaagaatccatattgcatcctgcattttcgcactgaatatatatctttttattgatattttatatctttttatccgtatttttgcaacttcctcgttaaatgtttcactaactactcaaagtatttctttttcagcttggttgtaaataccatataccagatcagtacaataagaaatacaaccatagcaatcagatccaaaactttcatagggaatataaagtaatggattgcatccaccgctccatacagggttgtgaaaatgccaaataccagaacagcggggagcgctttttgaataaactcctctttgttgctgcacatctgttccgtgattcccttgccaagcagcaggatttcattaatgtgtccgtcctttttcattttcacataggcgtacagcccatagatgccacatccaaatatcaggaggctgagcgccccaaacatatcttccatatattacacctctactcccaggatctcttttacggtatccttcatcttatctgcgtcgcactctcttgtgtgcagaatctctgcgttgcggatttcttcgattgcattcggcacatcaacctgtgatactttctctagttcatcaatcagtgcgaactcatcaagggcgtcatactcctggtcgatcgctgtcataacgcttcttgcaaacttatatggacttgcagtagatgcgatcagcgcttttctactgtctttgctctcctcccggtatgctttgcacacatgggctgctaccgccgtatgtgtatccatcacataaccagtggatcggtacgtatcacggatggctgcctttgtttcctcttcgtctgcaaaaccaccgataaaatcagccagtttttctttcatgtccggcgttatctcgtatgccccctctgtcttcagctgctgcataagagcggcatttttccctgcatcctggcctgcaatcgtgtaaatcaggcgctccagattgctggaaataagtatatccatagagggggacgaggtcagcacaaattcgcggttcctgtcgtatctgcctgtcttgaaaaaatcaaacagtactttattttcattggatgcacagatcagcttctcaatcggtacccccatttgttttgcataatatgcagcaagtatattgccaaagttccccgtaggcactgtaacattgatcttttctcccgcttcaatctcttggttctgcagaagttttgcatatgcgtacacataatacacaacctgaggcaccagtctgccgatattaatagagttagcagaggagaactgatatccggaatcagcaagttctttttccagctcccgatcctcgaacagagccttcactccgctctgggcattatcaaaattgccatggatggcaactacagacgtattctttcctttctgtgtcaccatctgcagttcctgtaccctgctcacaccgtcctttggataaaatacaataatcttcgtaccaggaacatccgcaaatcccgccagggcagccttccccgtatccccggaggttgccgtcagaatgacgatatcctttgttacgtggtttttcctggctgcagttgtcagcaggtgcggcagaatggaaagcgccatatccttaaacgcaatggtagctccgtggaaaagttccaggtgataagtatcccccaccttgaccagcggcgcaattacttctgtgtcaaacttctcgtcatatgcgcaattaatacagtgcttcagttcttcttcggaaaaatcagttaaaaactgcttcattaccgcataggcagtctcctgataggtcatatccttcaagtcgtccattgttacatccagttttggaatgctctccggcacaaacagaccgccgtcctcggccagtcccttcagaattgcttcggaagcggtcgctgtattgttggcatcccttgtacttttgtataatagattcattctcttaccctctttttctttcttcgctgtgttactgcactgcattatatcatatgttttagttttaatcaattttgtttgcgaaatataataaacagaattccgctcgctgccatcagcatgggataaaacaggtatggagtgatatcgaacggtgtaaggccggtcagggttgcagccgacagcatctgtgcgccgtaaggaatcatcccctgccccaccgaggtaaacatatcaagcagggaggccgaacgttttggagcgatctcatattcatcactgatttcctttgcaatcggccctgccataacaattgccaccgtattattagccgtacacagatccacaaacagtgcgagcagcgcaatgccaagctccgctccccgttttcctctgatcctgctcttaatcagccttagtataaaatgaatcccgccgtattcttttacaagagccacaatgcaggcaacaataatagagattaccgtaatgtcatacatggatgtcacgccgtctccgaccacattaaacagatcggctaccgctatactgcctgttgcaacacccacaatcagcgagattaccgtaccgccgatcaaaaccagaaatacattgattccaatcagcgcccccaccagtaccaatatataaggaagcaccttccaaaggttatactccatgattgtagtgctgctcagacgtacatctctggtaataatcaggaaaataataatcgtaataacagcagccggaagcaccagcagaaagttcgctttaaacttgtccttcatctcgcatccctgagtctttactgccgcaatggtcgtgtccgagatcatggataagttgtctccgaacatggcgccgcagacaaccgcaccgatacagattgccagagagaatcctgtcttttccgagattccgattgcaatcggcgccagcgcggcaatcgtccccatggaagttcccatagaaatcgagataaagcagccaatcacaaacagaccaaccacggcaaatcttgccggaagaatggagagcccgaaattaaccgtgctctccacgccgcctgccgccgtcacagcaccggagaatccgccggcacacaaaaagatcaggctcattgtgataatgttctcgtctcccgcccctgatgcaataatttttatcttttccccaaaagtcactgttttattctgcataaatgccacaaacaacgctatcaaaaagcctacgattgcgggcatcgcgtaaaaatctctggtcactattcccgcgcccagaaatataaccaggaatacggcaatgggcagcagcgccacagcccttccattgtctgcctctgtttttgtattttcctgtctcattccataccctctcttaatcaaaatatttcccgtaaacttcggatatctatccccagttcctcttgtctctggcttatatatatatctgcccctttataacaatacaggtcatgccggacacattccgccgccatggcaaccataggctttgattttgtccagatgacctcggacacagcatcgctgacgatctggccgaatacagcctcctttttatcggaaaccaaggtcagaaaacgccctcccatctcctctttcttttcttccagcattccatgcctgcagcagtggtccagcggtacttcgtcctgcgcttctccaaagtaaacgattcccagacggattccctttttctccagttcctgtatctcttccagtatctttggcagatcctctgcccagatctgcagcagcagttccgaacgtgtatccttcagaatgcttcggcatactgcgatcacattatcatactcccgtatatgccagaatctgtccaaatccgtctccgccctgtaatcatgcagcagctcctcaagcttattcaggatcttatccgtctcatccctgaccctgcctgaaatctcttcaaacggcactgccgcgtaacgatttgaacactcctcctcagaatacagtataaatcctttcatgacaagagattcgagcacattataaattttcgaacggggaaccgctgaatacttacttgcctcatatcctgtcatgcccccatttcttagcaaaacaaggtataccttcgcctccgaatctgtaaatccaattttatttaacagataaactctgtcatcctgcagcatttttctctccttttattgcggcctcttcacacagccgcatcgccccaccttgctctgcctgtctgcctgttcctgcagatagattcgggcataccttacgcctcttcagcggcgggtatgccattcttaccgctctcctttcccaatctttttccaggctgttgcacaccttcgctgctcctatgccaggaatgtccctactccggccgcaaccgccttatcatatatcttttttgctgttaccagatcctgcgttccgattccgaccgtcttaaaaacgataatatcttcctcagatctgcggccttctatatcccccaaaagcacatcgcccaggtcaccggtaaaatcatcctctgtgatcagccctgtttccagaggtataataatatcccccgcctccgacagcactgcctttctcgaatcaaaatagataccggatgcccgtttcagcacgaccggatccatctcctgcatatgaggctggttagagccgacacagctgacagtggcccccttcttcaccttgctgccatcgaataccggagccacagaaggagttgcgctaatcagcagatccgcatcctccacggcatcatccgagctttcagccgccagaatctgtgctccgtaatcccccagctcccgattcatcttctccacaaatgcccaaagcctttctttatcctgatcaaataccttaacctgatccaaatctctcactgtcagcattgcctccagctgcgtggccgcatgtccgccggttccgatcagagctcccttttcacattttttatttgccagcacatcaaaagctgcaccggaagctgcgcccgtgcggagttcatttacataatgcccgtccagcacggaaacaaccattccattcgtagaatcaatcaatataacctgagccggtgatggcggcattcccttttcaccattttctggtgttacgttaacgaccttgaggcaccccatatccatctcctccacaaaagacggcgtatacatcatagatcctccatgttccggtgcatgtatatttgcgtgccccggcgcctcgcccttcccggcggaaaaaaggcggaaagactccttcaccgcttccacggcatcccgcattgtgaatacctctttcatatcctccttagacaatagcagcatcttgcttcctcctaaaataaaaattccttccccccatatccgtagtatccccctttggtgactattattatcattataggcaggaagtcgaaatttgtcaattaggagcggaggtcgcctgtgtgtagggagagctgcggggcgggtgcctcccggggtaagcgttttcttctgcctggatgcgtccagccgccggaacggatatagggatgtctggaagcgtcttactgttgttagccggagttaagtaaaatagaaggaaacccggggtgaatcttttgataccgaatcaaaagattccctggcctcagcatgcgaagtcatcgggcttcggatgatgtggccaggttaccccggttttccttctattttactttattccggcttacagcagtaacccgtttccagacatccctatatccggctccggcggcggccccctcctcaagcaccgcccgcccctacttactgttcgtgtagtttacaaggcctccggctgcgattagtttctgcatgaattccggaaatggctgtccctggaattctgtgccttttgttcggttatagatctttccgctgtcaaagtctacctcgacttcgtctccggcgtctatattttttgcagcttccgggcattcaatgatcggaagtccgatgttgattgcgttgcggtagaagattctggcaaatgtttctgcgattacacagcttacccctgcagtttttaagcagagcggcgcatgctctctggaggagccgcagccgaagtttttatttgccacaatcaggtctcccggctgtaccttgtttacgaactccgggtcaatgtcagccatcgcgtggcttgccagttcctgtgcatcaaaggagttcagatatcttgccggtataattacgtctgtatctacgttatccccatatttaaaaacgtgtcccaatgctttcattatttgtcacctactttctcaggatttgcaatatatcctgcgattgcacttgcggcagccacttctggggaagccagataaatcagggattccacatgtcccatacggcctacaaagttacggttcgttgttgaaacgcacttttcccctgctgccattacccccatgtgtccgcccatgcagggcccgcagcttggtgtattcaccgcacatcctgcatctacaaaaatatccagaagtccctctgccatgcattgtttatatatcttctgtgttgcaggaattaccatgacacgcacatccggatgaacctcacggcctttcagaattgccgcggctttgcgcatatcctccatccttccgtttgtacaggaaccaatgacaacctggtcgatcttgattggctccatagcttctatctcgtcaatggtcttcgcattgcccggaagatgcggaaatgccacggtcggacgcacctctgacagattgatctcaattacttcatcataatcggcatcctcatctgcttcataaatcttatattccttcacggaatgctcttttatataagcctgcaccttctcatccaccgggaaaatcccgttctttgcccctgcctcgatcgccatattcgccatcgtaaaacggtcatccatagaaagttccttcaggccgtcccctgtaaattccatagatttatagagagcgccgtctacaccgatctttccgataatatgaataataatatccttaccgctcacaaaagcccccggcttaccggtcagaacaaactttattgcacttggcaccttaaaccacaattcccctgtagccatccccgttgcaatatccgtcgtgcccacgcccgttgaaaatgccccaagagcgccatatgtacaggtatgggagtccgcaccgatgatacattcacctgcggtcacaacaccagcctccggtagaattgcatgttccacccctgattttccctgctcaaaataccacttcagcccctggtccttagcaaactcacggatagacttagagttctccgccgacttaatatctttattcggcgtaaaatgatccggaaccaatacaaccttatctttatcaaaaaccctctccgccatttccttgaaaataggcagagccataggtccggtaatatcattcgccattaccacatccagtttcgcctctatcagctgcccggccacaacagaatcaagccccgcatgagccgccagaatcttctgcgtcatagtcattcccatcacaacaacctcctctttctaataaattctacctgtcattttatcataataaagcgtcaaagaaaagatgagatcttatcctttttccaatccagcccccgaccacttccccataattccgcgccatttcctcatcccctcttctcatatgcccacatcattcactaacttctatcccttccataatacacttccttatatatcagcttcctcgtaaggccccatactgcaaccttgtgccatctagtcccccgccgccatccccgtaccacaacgtcccccgtaatcccggccggatgcgcccagcctgccgccagagcggagtgcccccccctcccggggacgcatctggtgatttctagtgcatcaaagtgcgtattagaaaacgttgcgtcaaaacaggagccccacagagatagaatttgcttaccaaagcaaattctaagacgacctgagctgcgtagtcataaagattacgcagtgaatgccgtcggttctctgtgaggctcctgttttgatgttacgttttctttgcaaacggcctgcaccagaaatcaccagatgcgcccctcgggggttggcactccgctctggcggcaggtgcccctccaactttattttgcctgaatatattttttcgctgtcagtgcctctgcgcacaataccgctccgcctgccgcgccgcgtactgtattatgtgacagtcccacgaatttgtaatcaaacagggtgtcttctctcagccgtccgatggacacgcccataccattttcatagtctacgtccattttaacctgcggacggttatcatccttcagatactggataaactgctttggagcactcggcagttttgcctcctgagggaagccttgatagcttaccagtttatcgatcagctgctctttggttggttttttctcgaagtttataaatactgcagccgtatgtccgttcagaaccggaacacggatacactggcatgtgatcttaggcagctctgcttttacaatctcgccattttctacttttccaagcactctgagaggttcctgctcactcttttcttcctcaccgccgatataggggataatattttctaccatttccggccagtctttgaaggtctttcctgctccggaaattgcctggtatgtggttgccacaacttctttcggcccaaattctttccatgctgcaagacatggggcatagctctgaatcgaacagtttggcttaacggcaatgaatcctctggttgttcccagacgctttttctgatctgcaattacttcaaaatggtctgcattgatttccggtactaccatcggaacgtccggtgtccagcggtgtgcactgttgtttgatacaaccggagtctctgtctttgcatattcttcttcaattgctttgatttcttcttttgtcatatccaccgcgctgaatacaaaatccacagtagaagctactttttcaacttcattcacattcaacacaacaagtttctttacggcttccggcattggcgtatccattttccatctgtctcccactgcctcctcatatgtcttacctgcagaacgcgggcttgccgctacagttactacttcaaaccaaggatggttctcaagcagagagataaatctctgtccgaccattcctgttgcgcctaaaattcctactcttaatttctgttccatttttctctccttctcttttcctttggtttagacaatatttattccacagcctgctgcgtatcccgcccgaccaggcatacattaccggatgtcctttgggatattattttcttatatgcccaaatacgcctcttgcaaagcgataactttttccatggctgcttttccaggagcgccgatcgtgtttcgcatttccacacaggttttcatactgattgcatcatagatgtcttcttcaaataccggggatattgcctggaattcttccagggacatatcgtccagcgcaatatttttttctatacaataaagaaccagctgtcctacgatcccatgcgcatcccgaaatggcacgccatgatttaccagataatccgctgcatccgttgcattcgtaaatccgtgtttggcactgttctccatacgcgtttcattaaaacgcatggtacggatcattccggtaaacagcgccaggcaccccttggtcgtatcaatggcgtcgaacaccagctctttatcttcctgcatatccttattatatgcaagagggattcccttcatcgttgtgagaagtgacatcagtgcgccatatacgcgtcctgtcttcccgcggacaagttccgcgatatccggatttttcttctgcggcataatgctgcttcctgtactgtaggcatcgtcaatctctacgaactggtattcattggaattccagatgatcacctcctcagaaaaacggctcagatgcatcatcacagttgacatggcagacagaagttcgatcagataatccctgtctgacacggaatccatactgttcagcgtcggcccttcaaaatccagaagcccggccgtgtactccctgtccaggggataagtcgtccctgccagcgccccggaaccaagcggacagaagttcatgcgcctatagatatctttcatacgtgagcggtctctcttgaacatctcgaaatatgcgcccagatggtgtgccagcgtgatcggctgtgccttctgcagatgtgtgaacccaggcatataagtctccgtattttccttcattagattcaaaagaacttcaagaagctccttgagcagcttatccagctccagaatctcatctctggtataaagcttcatatccagagccacctggtcattgcggctccttcctgtatgtagtttcttcccgggttccccaatacgttcaatcagattggcctccacaaaactgtggatatcctcatactcgtccgtgatttccaaaacgccgttttccacatcggcccgaattccttccagcccatctataatctgctctctttcttccgctgtcagaattccctgttttgcaagcatcgtcacatgcgcgatactcccgcggatatcctgttcatagaactttttatcaaaagaaattgatgcattaaaattgtacactaattgatccgtttcctttgtgaaacgaccaccccataactgcgccatttcctgatcctcttttctctattttagattttctcattagtttatcatagtaacgtgctggtgtctacaataaatttcaaaggggtctgacccctttgcgttccgttttcagaatattctcattattcttttcttctgctctccatcgaaaactggcatccgcagtaatcctggcggtaaagcccgtgtgttttcgagagttctatcgaccttttatagccgtttttctttttaaagtcggactgcaggtattttattccatatctggatgctatatcttttcctattgtattcagcttttccgcatttttcatcggactgatactcagcgtggttgtaaagtaatcgaaaccgccttttgccgccatctgcgcggtctcattcagacgcagttcgtaacacttgaagcagcgctcaccgccttcttttacatgttccaagcccgcggccatgctatagaacttatctttgtcataattcccggctagaaaagaaaccggatgtttaaagttcatatccgagattaatgtctgctgctccagcagccgttttgtgtattcactttccgggaaaatattgggattataatagaaaactgtaatttcaaaatattccgataaatattccagcacataactgctgcaaggagcgcagcaactgtgcagcagaagccttggcacccgcccttctttctgcagagaagaaatcaggcggtccagttctttctgataatttacatagcgatagttcatatttaattgagacctttctatcgattcataataatatgaaggtattatatcacacctccctgacatcccgcaacttatgagtatatattccacgtgccaaaagttatatacttattgttcgtactctcgatggagataattattgaaataccctcagtcaattaccggggccttttacgctcaatcaagcgaattcatacgccgctgcggcttcgaagccactcccattggacgcccctcttttaccgactggatgcaccagccgaaaaaccgggcagcctgtctcatgccggtagcatatatgccattttattaatcctagagttaacgttagggacccttaaggaaaaaacatagaaaatggtgggcagaatttgcagtctcactgcaaattctgaagcggcctaagacccgaaattatcatatttcgggttgcatgccgctggaccaccattttctatgttttttcctttagggtctcttacgttaacggagcggattaataaaatggcatatatgctctcggcatgagacaggctgcccgttttttcggcgccctccccccattctactaaatcctgctcccactgcgcatccaaatcactttagtattccatccagtgccagattgacctggagtacatttacaaccttttctccaaaaataccaaggaatctgccggtcgtatacctttctatgatatcctgtacctcttcctccgtcatatcccgctcctttgcaagccgtggaacctgatattctgctgcgtccacactgatgtgcggatccaggccgctgccggaacaggttaccaggtctacaggtatctgctcatcctctgcatctggatttcctgccttgattttctctactcgttcctgaatctgtgcttcgaattcctcaccggcgggagtcttattagaaggccctgcatataccgtcgccatcccatctttatttgtgaaggtctcggtattgatattcataatccttccccacatatactcatcacctgtgaactgctgtcccagcagctcgcttccgtactgcacgccatctacttcaattatacttccatttgccttatctttgaaaaacaactgtgatatgccagtcatcagccagggatagattaccccgcataaaacgctgaatatgacaagcgccagaaacgctttcccaactactgactttaaagtcttcatctatcgacacctctttcttatttacttcctgcacattggctgatgtttagaatcctaaagctacaatcagcatatctattaatttgatgcagataaacggtgcaatgattccgcccaatccataaaccagcagatttcttgacaatagtttgcctgcggaaacttccctgtactttactccctttaatgccaggggtatcagtgcaatgataatcagggcattgtagatgattgctgaaaatattgcgctctctgcactatgcagattcataatattcaaagcacccaatccgggatacaggcccataaacagtgctgggatgattgcaaaatattttgccaggtcattggcgatactgaatgtagtcaggctacccctcgtcatcagcagctgctttccgatcttgacaatctcgatcagtttcgtcggcgaagagtccagatccaccatatttcccgcttcctttgcggcctgtgttcccgtattcatcgccaccgccacatcggcctgcgccagcgctggtgcgtcgtttgttccgtccccggtcattgccacgagatggccttttgcctgcagcgtacggatcatatccagctttccctccggtgttgcctccgcaaggaagtcatccacgcccgcctctgccgcgattgccgctgctgtcatcgggttatctccggtaatcataaccgtcttaatccccatcttgcgcagatcggcgaatttttctttcacgcctgatttaataatatcttttagataaatcacgcccaaaacctgatgatctttggctacgaccagcggcgtgccgcctttttcagcaatcctgcgtacgacttcttcgcattgggcgctaaagctctgcccatatgattccacatattcacgcacagcctctgctgcgcctttcctgatttcactctctgcagtattcactccgctcatccgtgtcttagcggtaaatggaatgaattccatatgaagctcttccagacttctctcacggaagttgaatttttcctttgccagtatgactatgcttctgccctccggcgtctcatccggaagagaggaaagctgtgccgcgtcagctacttcctgttccgtgtgtccgtctacggggatgaactcgcttgcctgcctgtttccaagcgtgatagttcctgttttatccaaaagtagtgtatcaacgtctcctgccgcctcgattgcccttccgctcatggccagtacattagcctgattcagtctgctcattccggcaatgccgattgcagagagcagcgcgccgatcgtagtcggtgccaggcatacaagcagtgcaagcagtgatgtcacggaagtcggattctcgattcctgcctggcccgctgaaaattgggagtatgcatacagggacactgttactaatataaagattaccgtcagcgctatcagaaagatttccagtgcgatctcattcggggtcttctttctggatgccccttccaccatggcgatcatcttatccaggaagctttctcctgcttcactggtcactcttacaacgatccagtccgatataaccgttgttccgccggtgactgcgcttctgtcgcctcctgcctcacggattacaggagcagattctcctgtaatcgagctttcatcgacagatgcggcgccttctacaacttctccgtctgcgggaatctgttccccggtatgaacgatcaccagatcccctttcttcaaatatgctgatttgacatgttcgatttgatccttctggtcagcagcaggaattttattcgccatcacatcttttttagacgccctcagggaatctgcctgcgcttttcctctgccttccgcaatcgcctccgcaaaatttgcaaagagtacggtaaaccataatataactgcgattcctaagataaatccagctcctgcatcctggatgccgaacaatgcaagaacaaaaaggattgttgtcagtatcgctgatacataaaccaggaacataaccggattctttacttctgttttaggtgacagtttgatgaatgcgtcttttaccgcccgcatcagcatctttttattcaccattgtgtctttcatcttttctgccattttcgttatgcctcccaacttatcctaacatctgaaaatattctgcaatcggtccgagcgacagcgccgggaagaaactcaatgccccaaccagcaggactacaaaaatcagcagtccgataaacattgcattgctggtggacagtgttcctgccgtaacagccactttcttcttcctgacaagacttccggcaatcgccagaaccgccatcatcgggacaaatctgacaacggccataaccagcccgagcgatatattgataaagagcgtatccgcgccaaatccggcaaaagcggagccgttatttccaccagctgatgagtatgcgtacaaaatctcagatagtccgtgtgctcccgggttattcagactgtcaagcgtagatgggagcaccgctgcgataccgctaccaatcaggatcgcaaccggtgttgcaaggcagacaacgcatgccatcttcatttcatacggttcgatcttcttacccagatattccggcgtccgcccgaccatcaggccggcgatgaagaccgtcatgatcgcaaatccgagcattccatataacccgcatcctgtccctccaaatacgacttcaccaagcatcatcaggagcatcggtatggcccctcccagcggagtgtaggaatcgtgcatggaattgacggagccgttagacgccgcggttgtaaagaccgcccatgtggaagatgttgctatcccgaatctggattctttgccttccatattaccgccggattgtccgtccgtatgctctatattgactgcaccatccgctgcaagctggggagtcgcattctgttctgaaattgcaacacctgacaatgcaagaaccagcataatcatcattgcagagaaaattgcaatgccctgctttttatccttaacatttcttccgaacgtgaagcacagcgccacaggtattaatagaagagacagcatctcaaccatattggaaaatggcgtcgaattctccagtggatacgctgagttcacgccgaagaaaccgcctccgtttgtgcccagctgcttaatagcgatctgacttgccgccggccccatagggattgttgcctctgttatctcctccccctcttccgttgtgaccggctccaccagctgcgttgtctcatagctgttcatattttgcacaacaccctgagacacaagcagaacagttactacgattgacaatggaacaagaacatacaggaccactctcgtaagatcggcccaaaagcttccaagcccctccgactttacttttataaatccacggattaaggcaaacagtacacagattccgactgccgcagacacgaagttctgtacggtcaaacccaccatctgtgagaagtaagagagtcctgtctcgccgctgtaagcctgccagtttgtgttggtcacaaaactgaccgctgtgttaaacgccagatccggactcatcccgctaattccttccggattccatggcagatgtccctgcagcataagaatcaggaataacgcaataaagctgaaaatactgaaaagccctacgctggccgcatattttttccagcccatctgttcctctttattcactctgagggctttatagaccagcccctctaccggtgacagtatcttgctaagccatactttttcaccattcataatttttcctatgtagcccccaagcggtattgcaagcgctactaggatgacaacataaagcacatactgcaaaattgtatttcccatttatttttcctccttacaggtctctaatttacgccagtctatataaaattgggataataaaaatacattctggtattaaaatgacattaaaacagcaatccgcaaatctattcctttctcataaataaggggtcaggaccagggattttccagttctgcatcatactccaggttcctcagaaaaaaatagttttttttccccttaacttcgcttgtcatcctgatacagtcattcatgtcaaatgccggttctaccctgccctccttttcaaaagaggcgaaccgttccatattaaagtttgcaggaacataggatgcatccaaggcctgtgccgcccggaagtgtttcatggcttccgcatgcctgccctgtttttccatgacaattcctcgtaaattatgcggcaccgcactgtccggatataactccatatacttcggaatcagacggtcacactcttcccacttatgttcggacacataattcctgatgactctgcagagattcttcagatcatcctccatatcaaataaatttccactcccatattcgttagattctttcttcattataaaagcctccctgcttcggatgcgtactgctttaccgccgcacccatatcttctctttactactaaaaaatagcatgctttgtattaaataggtgtgaaagaacatacggcgggtattaaaaaagtataaaaaccataaggaggaggtcaagggggtctgacccccttgacctccgttttcagaatattctcaaaaaagcgggaagccgtgggtattcttttcccacggcttcccgcttttatcgcatctgcaaattttctaatccatgctttatgtttcaacctcctgtatatattttgaaaatattctattcaagatacaggccgaaatatatgctgttcctgagacagcaatgataattagtaccggtaaaagatacagatcgatggccactgccagatacggtatgagtattacaatcatcatcaggattgtacggataatatgcctgaagcataaaaatatggatattttcaatatttgtataattgttgtatcaaatttagccaataccggcgccagatagatacctatcattacatatagaatagacataactgtaaataccgtcaggaaaaaagcctgtgcaaaaagcttccctgtggccgccgcatacaggttgaagtaaagtattcccccaactcctgcataagccagccaaatcaatgtcccctgcctgaaatttttccgaaaggcctgtacaaaggaacggcatatataggactctttattcctgcacattttcagggtaaccgtatagagagctgccgtagatgcaccaaccgtaattatggggaggctgaaaagaatccacagtatattcagtaaaaacaggttgctgattttataaagaaccggcataaaaccgttttccgggctgaacactctctgaatcatacatagcctcctttctctgtgagcactaatacggcggccttatgaatcaggccataccagcggaatggaatagcctcattttgccttccgcaatttcttcacactttgtttttacatatttcatatagtttcttggatcaacctctgctgtttcattcacagcaacagcatctctgattgcatttgtatacgccgccttaaattcggtccccacattgatcttactcatgcccaggctgacgcatgtctgaaaatctgtttccgacacccctgtccccccatgaagaaccagcgggcaggatgttaactcagcgattttcctaaggcgttcaaaatccagtttcggcgtactcttataaaatccatgtgcagtgccgattgccactgcaagtgcatctactcctgttttttctacaaattcgggtactctctccgggtcagtcagcgcactcgaagcatcatcaacaacgatctcttcttcccggccgccaattcttccaagctccgcttcaaccgaacatccgaatttcttcgcatatactgcgacttctctcgtgatttctatattctctttaaagtcttttttggatgcgtctatcataaccgaggtaaaaccggcgactaccgcttctttgagaaacaccgcatctgttgcatgatccaaatggagacacaccggaatgtctacggattccgccatccccttaatcatcccgactgtctgtttcagtccgatatatctggcagctcccatagaggccatgagaattatgggggagcgcatccgaagcgcactgttcatcatcccctgagcatcctcataaccattaaaattaaatgccggaactgcatatttcttttcccttgtttcttttaagatttcttttaacgtgactaatgacattataccacactttctcctttcttccctatcgttatgtatttttccagtctatttacttcttctttcgttatcattgccggaccaattttatatgtatttgcaagaccacatgcaccggcgtatttcaggcattcttctaatgacgcatcctgtgcatattttgccagataacctgctaaaaaagagtcccccgaacctacggaatagtttccgccctgtactttttcggcttttccaaataggcattccccgtttttaccacaggctatacttccattttcaccatccgtgacaatcagttcttcgattcccctctcgaatttaaagcgctttaattttttggtaaaaagaaaagcatccaactgaaacgcttcttggaattcctctctattcactttcatcagacttaatgggtagtcccctgctgctttcagccagtttcctgaaacatccacagcgaaacgatgccctttataaaccccatattccaggatctcccgaaaatcttgttccgatattcccctgcatggcgcaccgcttatgacaaaagactgcttttcctctgagtccattatgccctttaataatatcttaaggcccgagacctcttccctggatagtacgggacccggatcattataagagagtgtctttttgtcatactccagcatgacacaggtattaatccgggattcgccggcaatacggtactccaggcagttcagatgctccttcctgcccagatcccggattatttcccctgtctttccgcctaaaatattcatgcaaacatattctttacatgccagattctttaatgccctggcaacattcagcccttttcccgatatgatatgcagcacctcgtctgcccggaacacattctgtacagcaggcctgcttcgcacaatatgccactggtcatagccgggattcaggcttaaaataaagtaccttccgcctttcatttaatccccctttgttgttttgcgcaccactaaggacggacgtatcagatgctggaccggctgttttggctggaagtctttattcatcttctgcatcagcagatttacggtattggctgccatgctgtccaaatcctgatgtactgtcgtcagtggtttgtcggcaatcagatgatagaagacatcatcatatcccgccagagaaatatcttccggtatacgatatccgcattcctggatcgcctttttgattccatatgccatataatcattcagtgccagtatcccatccggtgtccggccactctggagaagctgcttcgtttttgcataaccgtattccacactgatatcatcacagcccacaatccagtcctgttccacgtccagccccatctccgcaaatgccctcctgtaaccgctgatacgttcctgggcgaccggcagctttttatcactggtgacaaaataccatagctcgcgatgcccattttctaataagtaacgtgtcagctggtagctgccctccgcatagtctgtcaaaacacaatcttttttaaagcctgtataataggaagtacagaacacgatcggaatcttattctccttcacatccgtaaaaactctgctttcatttttcctgatatttagcggaagcacgataattccatcgtactgtttatccacaaaattctccataatacgagtttccatatccggattattattggacacaccaagcacaagtgagtacccatattgattgcagtaatgccccagcagcttcatgagtttcccgtaataggggttctcggaatccgggcagactaaccctattgtcatagattttctgagagctaaccctctcgccaggggattcggcttatagttcatctcctctatgcacttcagtacccgctcccgtgtacggctgttcacgacactcttattattcaataccagtgaaacagttgcctccgatacacctgctttttttgcaatatcctttagtgttatgttccccattatctcttccttttcctacttgtgccccattttcggcaaattttctatattgatatcaggtccaaaatatttatataagacaaggtcatgtttgcctgtgtttttaattatataaccttcctttgccctttggcaagtaattaagagctcatccatacaggaatacaggtcaaattgccctgccgccacctcctggccgccgactgtcccctgccccttccagacaaagatattgtgtacgcctccctcacggctgaaaaattcttcacccggctttagaatcagccttttcccgctgaatttaggagtcccataatagatccagtcttccgagatatccccctgtctggtctcctctacaggtttcggataaatatgcctcttctcataaaaatcaggatcgctgcttgcctcccagtcaatcagatctaaggccgcttcctcccctctattctcaacctcttcctgtgccacgtccttatacagcatgcttttgggaatgctgcagccctccacaacgggctgaaatacggtacagacatcggaagactcctggatctccattgtcaatgcgctccccggcgcatgaagtattcccgaatccaggaaaaatccttctcccggtacatttaaaaaggcccgggaatgtttcaagacctcttcctctccagctttccattctttcaggatcggaaggaatatctctttctggaggttttgctccacaatatactgatgtactccgaaaaaactctccggatggtttccaagcggcgcatccagaaaatgatatgcttcatccttggaatttttccctatctttttcatgtcctctgccctaggatggatatggaaaaacagcctggtgccaaaatcatatattttgatcagccgtcccaggcagccgtgcttttctgcatattccgcccccagaatctctgtcctgcataattgcagtgcatcacgcaccgtaatattttcacccgggatctccagataagaatagccctcatccggtatatcaattctgttatccgcatgcgtttccgagcagaaccatctttccattatgctgccgcgttcacctgcatcatagtcttcctccttcagccccagcctttttcccggcttcagaaaatcatgtgccacccaggccggacgcagccttaatatcccctgcatattttgaatataatctgatataaccgcctttgtatctttcatctttctcgtctcctatgctgttattttgtattcttatcccttaattcctgtagatgtgatcgcctctacgaacttcttctgcattccgataaaaatggcaagcgcagggatggaggttagaatggagattgccatcagaagaccatactgcctcgaggccgatgactcgctgtaacttgtcataatcgttgccaggccgaccggaagtgtcatggatttatccgtaaatgtcaccagcagcggccagaaaaagttattccacgatgatacaaaagtcaaaatgaccataaccgatatggccggcccagacaacggaagacatatcttcgtcagtatggtaaaatggcctcctccgtctaactggcatacctcgctgtattctttggggatgccgcggaaaaactgataaagtaaaaacacaccgatggcatcgcatatctgtggaatcactactgccgagtaggtatccagaagccccaatttagctacgattttataagacataatggaagataattctttgggaatcataatcgtcgcaaccatcagcatgacaagaacacccgaatacttaaactctattcttgccaatgcatatgccggcagtatatagaaaacgcaggataatacaataaccaatgcaacgacaatcacactgtttttcatccacacgcccaatggataggcctgcacggcctctgcgtaattttcaagagtcggctgaatcggaagccaattgtatagaccattgaagatctctgccgtcgatttgaatgatgttgatacaatccaaatcagaggaaaaataaataataaaacaaccagaatcagtatgatatacaatatgccttttgtaatcaggctgtttttctttttacttttcatgtttccccctccttctctggctccgcttgattctccattcatcgcggtcaagaaataccccgtaaatcacaactgacatcagcagaatgatgataaataaaaccactcctattgttgctgcatagcccagtttaaactccctgaatgctttgatatacagatactgcacaaaggtaagggtgctatagttagggcctcccgatgtcataacatagacctgtccgaatacctgcatggaatatattactgttgtcagcactacgaaaaatgttgtgttttttacatatgggattataatacgcaccaatctttgaaaccggttggctccgtctatggaagccgcttcgatcagatcccgcggaacatcctgcagagccgcaagataaatcaccgtattatagccgattgtccaccatatagaagccactgcgataccgagcatcgctgtggaggtctttgtcagccagaagaccggctcaatacccaaaaacgacagatagtggtttagaattccattgtttccgtccaatatgtatctgaatgtaataccgaccagggttgtcattaagatataggggacaaatatgacggcccttgagaaggttgttcctttcagcttctggtttaaaagcagtgccaggagaaaaccaaatatgatattcactgggcctacatataataagtatgtaaatgtatttttcagaaccttataaaacaaagggtcctgaaaaagcatcttataattttttagacctatgaaagttcctgccgtctgcacctctatttctctaaaactgtagtaaaaattggcaaatatggggagaattttaaatataaacagcagcacaaaatatggtgcgagaaataggagcagtatcccggcttttttcatttttttctttttatttaccacgctcatccctccgttattatccggcggcagtgtatggtgaggtttgcagcactgccgcctaatacggcatttctcagacagcaggcgccctattcattgagacctgcccgttaccgtacgatgttctcccgcctttaattccccagtattttatcaacactctctgcagcttcatccagagccgaaacggaatccttttccttgctgatcacactgtatactgcatttgcaaccggtgacagctcgttatccgcaccaaattcactggttcccggacataacggctcatatttcacatattctgcctgatcaataaatgcctgtgcatattggtacatctcgagcgccttatattcctccgattcacgtaccttctggtttgcaggaatctgtccgctctgtgcagcccagttaaatgaattttctacgatccaaccgataaacgcctgtgttgcctcggtctcttcctcacttcttttatcatatctgggaaccgtaatcgtatgagaacttccccatacagaattttctcccaaaacctgtgggaatggtacggtggtaaaattaagatcagatgccatagcggaaggtgtaaaccacggtccttcaatcaccattgccgtagttccgcccagccagtccgcatcgatatctgcttcagcttcgggagcataaccttttgccacccagtctgccagaaaatccagcgctttggcaccagcatcactgttaaattctgcttttgtcatatctccattcaggaaactacccccagcctgtcccagaagtccgtaccaatatctgtaggtatgcgcgtaattactgccaagtccgaccgcatactggtcatccgtttttaatttctcacagagtgcgttgaattcatccacggatgttactttcgcatcttctgcagtaaggccagccgcctcaaaagaatccagattaataaacattgacatgcaatggaagtccagcggaatcccatactgcttcccatccacctggtttcccttccatatgacatccgaataatcctcttgattcacatccatcgttccaatcaaatcatccaggggtacgatcatctccttgcccgcatatgtagacagatctgtgggatgcatcagcatgacatccggtccgctttcggtattgctggcggcagataattttgtaaaaatctctccccaggtaactgaataaaagtctacttcgatcttatcttgttcactgttaaactgctttaccatatcagccattgcctgctggtcatcccctgttaagcctgcccaaaaggtcaattttactttttctccatcagaagactttgtatcctccgaagattttccacatccggctgccagtgctccaatcatcatgatggttaataaaatggaaactaattttttcatacttttcctcctttttcacttaaacttcctcatcatacagaaatgtccggacaattttgtccgttctgtattcctctccggtatggcatataatctgatactccggctgccacaaaattgtgtgctcctgctgtttgcagtaatcgtcccactgcctgaccttctgctcatcgcgctttgcctggcggttgacaatccttgcgtagagcactttttccggcacctgcagaacaagggacaataccttgaactctatgtcatacttacttttcattccgtcaaaaaagctcggctgcctcatttccttcgataacggtgcggacgccgctatgcttatgcccgcccttaaattttccgctatcacattccaaaaggtttcataacagcattcgcgccagatagaacaaaattcatcgtatgcccttccctgataaaatctgtcataaacctctgtcataaacggctggatcactccatcgtaatcaacgtatggaatcttatatttgtcagacagccatctgccgcatgttgtctttccgctccctggcagaccagatatcaaaattaatcgtccgctatcctgcttcatatctttttctcatctccgctaagtactctgcgtactgcaattggggcgcaaccttcgattccgcaagaagcgtttttttcatgttccttaacaagttttcccttccgctggcgcataatccggagatcgctgcacccagcccactgatttctgatgtttttaaaattgtaatttctctgtccagtgctgcagctttgaactgcataaataactggttatccgtaatgccgccgcctgtgaagtatggcatctccttttgggaaccgttacagtaccggcttaaatccgcatacattctctccgtcccgattgccatatagacataaccgcttaagagcagttccgaaagggaagtattttcctttacatccagtaagttgatgtagcgcgcatgctctgcatatctgccataatctttcggacatgctatcctgcagagcctgtccacatccggcaggttaaaaagcctttgattggcatcatcatagaatgcctggtcagcactttttccggctaaccctgccagacatttcaacactctcccataatagtccagggatctgttcaccacatattcctccggttcaaatcctgtgaccagacagccgccctttggattgaatgtagctgtgccccgcagttttttttcgccgtctgcttttaccattgccagtacagaagaagagcccattgaatcgtaaaacaaatctgaacttccatatagctttctcactgcgtacagtccgacataatggtcatgaccgcccagtccatatacgatcccgtctttactcccacagtacccgcctaagcttcccacaggttttggaagcttaatatgcagcctctctgcagtctctaaatcccatgtctttttatggatatcataaagatagctgcgccctgcctgggatgtatcccatcttgcagtacccgttctgctataagtcaaataactgctgatcggaagccacatatccggtatcccggacagcacgttctccatcatccatatcatcttatacacggcaaatgtcgatgatttatgtacccctgtattagcaaaccccgatttcttacaaaggatctcatctttccattttggaatgtcatctgtctgttcatgccagaccaacggcatacttaagacttttcctgatttcatagggatcaccgattctcccacactcgaaaatccaacactctttaattccgagattttaccggcttcttcaatccaatgttcaacacaggcatctattttctcaatatcaaaataagaacggccatcctttaaaacctgaggggtctcctgtttccatattgagaggatgtctccattttcccctaaaagaatggctttactattcgttgttccgacatcaattcccaaaaatccatccatatttttatcacctcctttcgtttttaaagcgctttaaatttaatttgaatatactatacttaaatatatttgtcaattattttcaggattcgcatcaagtttcgtcaatttttaacaattttagcttataattttctgatattattaccaatattcaatttttaaatctgtttaaatagataatttatttgtatttccaagaatcccctacttgttaacatccacttgcaaagggcagaaaagaatgttcgggttctgactcatgattttgtattttttacacccgtatattcttttttcttattttattgtttctttttattttccaatgaaaaacatttcctgccgcatttctttctacatagcaaataaagtttatagaattacggaatagcttttcctgttttctgtcagctaccatagatatacccataagaacggaaattagagggcagcttctgattctatctgcgagttctttcacccatcttaagttttctcataaactaactatatacttgtcgaatggagtgtctgcatggaaccaatacttgaattaaaaaacataaattatgcttatcacacattagaaggagaaaccaaagcactgacagatatttccttttccatcgcctccggagagtttgtcgctattgtcggtccgtccggatgcggcaaatctacgctgctctcgattatatccggcctgctggagccggaaaaggggctgctgaaaactaacggaaaatatttaagagaaagtaccatgaatatcggatacatgctccagcatgaccatcttttcgagtggcggaccgtctacagcaatgtgctgcttggtctggaaatccagcatatgctttctgcaaaatcgaaagcgaaggcaaaagagcttctcgaattgtacggcctcaaacagttcatcaattccaaaccctctgaattgtcgggagggatgcgtcagcgcgctgctctgatccgcacccttgtcctggagccggatattcttttattggatgaaccattttctgccctggattaccagacccgtctttccgtaggcgatgatatcggacagattataagaaatgcacacaagaccgcattgctggtaactcacgacctctcggaagccgtaagccttgcagaccgcgtcataatcctgacggaacggcctgccacgattgccaagatagtcccgatcacatttacccttgaaaaggatactccccttctgcgaaggaacgctcccgagttcaaaaattatttcaatattatatgggaggagttgaataaaaatgaatgagatttctgttggacagcaaagttatctggacagccggaaacgccacaaaaggattgtacgggtctcccggattgcaatccttttgagttttctgttcctgtgggaattcactgcaaatgtgggaatcattgactccttcatcttcagcagcccgtctaaaatagccctctgcttctggggaatggttctggataagacgatctttctccatatctggaccactttgtatgaaacgatcgtcagtttcctgcttgtcaccctgatcagcgttatgctggcggttgccctttggtgcagtaaaaagctgtcggaaatactggacccctatctggttgtcctgaacagccttccgaagtccgcgctggcgccgcttctaatcgtctggctgggcgccactaagactacaatcattgtagccggcatgtccgtcgcaatctttggcagcatcctgaatctttacaccagcttcacgacggtggacgaggaaaagataaaattaatctatacactgaggggaaataaatggcacgccttgacaaaagtcgttctgcccagctccataccggctattatcagcaacatgaaggtcaatatcggactctgcctggtcggtgtcatcatcggggaattcctggcggcgcgcaatggacttggatatctgattatatactcttcacaggtattcaaaatggattggctgcttatgtcaatcgtcctgctctgtatcatggcaatggggctttacgcactgatcaacctgcttgaaaaagtttatcagaaaagaatttgacagaggggtctgacccctttgctcacatcttctctctatatgttcgttctgaacattaaaaagcagctgcggttcattcccacagctgccctacatatccttctttgtctgtcaaatgcaaggtgcacgaagctgtccaccttaccaaagggtctgtccccttttattttctaaaaactccaaatacaaataacagcatcccaattagaattaccgccgcgatcaccttctgaaacggatgcgtactattaaagtccttcagatatatgttaggattttcaagtgtgatccccggttcactgcggttctctttcaactggaagtcttcgataacatggtgccaccctgtggaatcggtatacaccttcacatagggcgctcccaaatatttgtgcagcggaatacggtaaggggcactcttgatccgctgtgagacccccgtattcgaatcgaatacttcaataatcagaaaataatatgtaatatactgcctgttcctgctgttggaatctacataatactcccgcacgatattcacgatcttacccttctgcggatgccccgcctccacgcactgcgcatgcagtctccggtagtaaactgccttctgcaccatacgcactgcctgaaacgggagcagaagtcctgctgccagaaagatcaaaataaaaggctgaaatccttcccgcagtatgtttcccaaaagccctgcataccatacgattgtaaacaaaatcaaaaatactacattgcctatttcttcattcgctgtccggatttttttatgcatatgtcctcctcgatctaatatcgctttcctataagatatcataccacagacaaataaaaaaatctctttaattaatagaagaaaacgtaaaataaacagtaataaaacaagaatccataaacaacgagcttcagccttgacagcagatgggggcgccaaccggctgtcattttccggtgcgccctcatctgccgccaaaactaaagctcatctcatacaatctgttgcatattcgttaatattcctaaaatttctgcaccacttatttaatacgtgtcagatgctggcagtagacatagatattctggatcttcttcgcctctacgccgtcatccgcctgtatcacaggctgcgtctccgagggggtaacgtagagcttaaacacaatcgcatcctgccctgccctcatatttctgatctttttaaattcaaagtcccgttttgtaataccgaggtaatcaaaaataactgtctcaatgtcaacattggtaaagcagcggagaatcatatcctcatcgtacatgtctatgattgccttcgtttcttcaaacgtaaggttgctgcatttaaattcgccttcgttcaataccgacatcatattgctgttgtcaagtaacagtaaaggttttgcaagttttccgcccatatcagtccctccctttcttacgtggaatctgaatagttacacacagcatctcttctataatttaatgataagcgtatgggaagaaaattacaaccaaagttattaacttaacgggattgttaatttattcgccgttactattcatggcccaggggccgcgcatcgtaactattcgccttcgcatatttctgctattttctgccctgtcggcgtacaggcaagtcctccgtatgtaccctttagacatggaggcagctgctcccctacttctttcattgcgatgatcgtttcatccagcggaatctgcacagaaaatccacaaagaaccatattggccgatgacaaagcatttgataccgccatagcattgcgggcattgcacggctcgtagcctacagataccgggtcacagatcaggcccagtacattctgcagggtgactgcggatgctgtaaatgcctcctgcgcggatcctcccagcatctctgccacacccgctgccgccatggctcctgcggaaccgcattcagcctggcagcctgccacttcacctccgaatgtagcctgatgtgcgacaaagattccgacacagcctgccgcaaacattgccttcgcgatctcctcatcactctttcccatacggtctccaagatggacaaccgccgcgggaaggatgccgacagaccccactgtgggagatgccaccacgacatccggcctcttctgctccaccttctccaggataccgatggcaacgcagaccagctcgtttaaaataccgagttccgcaaccggaaccgttttattctgcatactctcgtacatgtccgtggctttaaccgggtacagctcccctatcttttcgttcgttttattgtggatcgcgacatgggccgacctgcgcattacccctacaatgttctgcatcatctccataaccttttcccgtgtgtagccgctgcgcgccatctcataacgtatgcccagctcaccggcgctcatattttcttctttgccaaattccaatgcctgcgccgccgttctgaaaggaatatcctcataagcaaaactggacaggaccggaagtacatgatccgtataacgtacatcggctacaccaggcatatccagcatcttctgaagctgtgtctcctttagagcctcccgtgtctcaaagtaaagcatacgtttcctatccgaagcgctctcctttacccggaattcctgctctgtaatcgctttcaggccctcttcgaccgtcccccgatgcgccgtatcatccagatagagaaatgcggcgttgaaatctcctttgatctggatcggaaacccgtcgatttctatgatctcaatggccccgccgcctaccgaggtcgtgcctagtgtcagacatctgccgttctttccttccatttccatcaatgcataattcgcatgtttattttccttcggttctttcacaaattggatgtctacacctttttcttttgcaatttccagcgcatccgtcatatcatcgctgtcgatgcggccgccgatcagtcctgctgtaaatcccctgtctgaccactgaagcttataatacgaagcgtaagagctgcccggatcaaaagaaattcgcgccctcttcacctcatcgcccagcagcatacgggcaacagccccgattctatagggacctgccgtatgggagctggatgtgccgatcatgaccgggccaaacacctcattaaatatactgccgtaatattcctccattttatcctccttctcagttatgaatcaataaaatatttgtaaaacccaaaaacttactttgttctctgcgggtaatctttttccagtgtctttttcaccgataccatcagaagaaacattacaaagatcagcggaagccccgtcacaacagacatgatcttcactgattcaattcctccgatcagcatcagtgctatagaaagcatacagaataacagtgcccagaagagccggttccatctcgcaggctcccctgtcggcggcagttcctttgtagttgcgcctgccagcacatacgcacaggaatcaatggtcgtggccaggtacacaaaacagacgatacataaaaacagcatcatgatctttgccattggaagcgttttcaaaattgctataatcgcctggctctgtccctcattgtttaaaatactgaccagatccaccctgccgctcttctgcaggtacagagaatagcctccgaagatcataaaactgaagcagcatcccagagagccccatatcaactgcccccacatgacatttttaatcgttcttccgcgcgatatctttcctacaaacattcccatcatgggcatgaaagcgatccaccagccccagtaaaatacggtccagtttttcgtaaattccccgcttccaaagggctgggtgtaagtactcatcctgaaaaattcctgaagatacaatccggtactattcaattccattttcaaaatcaccaccgtaggccccacaaataagataatcagaagaaagataaatgccatcacgatattgatattgctcagtttctgaattcctttatccagcccaagaaaaacgctcgtgccgaaaatgaagatccaaatcgtcaataccgtcagcttcacagtcagatcataggcctgcgggattccgaatacctcccggattacatccgccagaactggtgtaccgatgcccagtgaggtggcaatggaccctaccaccccgaataccacaaggatatcaatcacatgtcccagccatccatttgtctgctttttcagaacaacgctgcatgcagagcttaaacggatgcttggttcttttcttacatatatcatgtaggcaactgctataatcgcagggttataaaatgcccacgcactcagcccccagtggaactgtccgtacatgtgtgcatactcataggcctgttcgcttaaaggctcgatcagaaacggcggactgctcacataatagattggctccaggaaccccagtatcacgatgcttgttcccacaccggccgtaaacagcatggcaatccaggagatctgcgaatactgaggcttttcctccttatctcccagtttaatactgccaaaccggctggacgtcatccagatcagaaaggcgaaactgcatatgcaagccgtaagatagagccagccaaaattttcggtacagcggtcatacaaaaaattgatagcctgtcctgctttaaccggctgtaaaagtaaaaccagtatcagcaaaaccagtatcaggcatgtaggtgcaaaaattttcagattaatctttcgaaatagctttctcataaaggactcctttagcagcgccgtttctctccatatttcacaatcaggctgtccgcgacaccaacgccttcgtcttcgggataaacgaataatgggttaatatccagctctttcaaagagtctttgtttgcagccgcaaaattcccgacgcttacgattgtatcacataaagcgtcaatatcatacttctctcctcctctgtatccatttaataatttgaaagcctttaaggactgcagcatacgcattgcctctgccttattgaccggcgccgggtacaccacgacatccttgaaaagttcgacaaagattccacccattccagccataatcattggtccgaactgcggatcattgttcacgccaataatcatctccagtccgggtttcagcatagggaccatcaaaatcccgtttattccggcttccggacaatgtttctttacattctccataatcaggtcaaaggcatccccggcttcttttgcgcccttcagattcagaagcactccgcccacatcgctcttatgcagaatctccgcggattcaatcttcatggcaaatgcccccggcattttttctgccgctatttccgcctccccacgggaggttacaatcaactcctctgccgcagcgactccgaattctttcaggcacatcttactttcatgttccgacagagcgcaggtctgatcgctttttctctgaggcagtgcgatctcatggctgacgctgctgtaatcaaaattgatgtaatccgccagctttttcagcattttaaatgcgtacacaggcggaggcagcacaggcactccgatccgaaataacttttcctgatattccggatttctcgtattctctgcaaatgggataattgcaatcggcttacatcgatctccctttttcatggccacctttttgatgccttcatacatataataaatggcggggtctgcaatctcatataaaagagtatacccgatcagaaccattcctacatttggatcatccatcacggtctccagcacctttgcatacagatctgcatcataggacagggtggccgtcatatccagaggattgttcggagttgcatatccgggcagctgctcttttaaggccgccagcgtctccgatgtaaagtccggataggaaattccgtttaaataccccacgtccgcgcagatcgcagtttcccctcctgaaagattcatggaggcaaactccgctttatcgggcaatcttgggatcgttgaaagtaaaagcgacaacgctgttaactcttccaaatcatccgctcggatcgcgccgaactttttcaacaaggcgtcgaaggaagcatccgatcctgacagactaccggtgtgggaggccgcgatcgcctgccccttattgcttctgccggctttcaggacaatgaccggttttttctttgccgctgctttattcagcacttccacaaacttagacggatttttcactccttctatataaaggctgacgactttcgtgtgttcatcctcaaccaggaactccatataatcttccatttggattccttttgcattccctgcggaaatattataggaaaacttcatggacgggcactccatcatcgagagacacagttggccgctctgggagatcacgccgatattcccccttcggtcgcgctctgctgatataaatgcaaacgcatatacatggtctgtataattgacataccctgcacagttcggacccatgatggcaattcctaattcctcggctctttccagcagctctttttcctgcctaatcccctcttccgtacccgtttccccatagccgctggcaaagactaccgcaccgccgcagccttttcctgcaccttcttccagaagcggaagtatcgtcttctgggacgtacagataatcatcaggtcaatcacatccgggatgtccgtcactgacggataacattttctctcaaatacggtgtctcttctcggattcacgaaataaatcctgctcatatccttagtatatgtaataatatttctgcagacatcgcctccaaatccatttttttcacttgcgccaaccaccgccactgactttggtttcagtaatttggtcaagtccatctgaccgcctcctttttatgttcttgtatcactatgccttttgtactgtttccacacctctgcggtagcatgctgcattcttttcgttaaatcttccttttccctttttctcaaaaaactgcaaaatcgactcttccagatattccaccgtaaagagatctgttgccgcagccaaagctccaagcatcacaaggtttgccgcttttaagttctgtacttcggcagcaatatctgtggcaggaacctttatcacggtaatatcctccctgtatgtccggtctttcggcacaatggaagaattgaccatcagaaggcctccgctcaccagactatcttcaaacttatccaccgctggtgtattgagggtcaataaaatatccgggtgctttgaaaccgggcaggcaatcattttatcgctgatcttcacggtacagtttgccgtccccccgcgcatctctgatccataagaggggtagaacagcacgtttttgtccagcttcatcccggcatctattaaaatcattcccgccgttagtacaccctgtccgccaaatccggcacaaattatctctttcttcatgatgcatgccctccctgatctttaaattctcctagcgggaagtattttatcatttcctcattaattctctgtgcacactttaccggcgtcatattcaggttggtcgggcatggtgaaagcagctcgaccaaacaaaacccttccccgtccatgtgcttttcaaacgcctttttgatatactttctgctgacagttatcccctttgcatcagccatgcttcctcttgccaggtatgcaatgtccagaccggaaaaagcatcctcaattttaaatggttttccccactggtccggattctttccgtgcggtgtggaggttgtaacctgtcccggcagggaggtcggtgcgcactgtccgcctgtcatgccgaacaggctgttattgatcacaatggtgatgatgttgtcgtttcggattcccgcgtgcatcatctccgccatgccaatcgcgtaggccgccccgtccccaagataagccagaaccggattctctttccgtacttttttaattccaatggcagtcggaatcggccttccgtgtgccgccataatggtatcaaatctccaggaattaatattcaaagagccgcatgccacatccaccaccgtaataagtttttcacttagttccatttcttgtgctacttctgcaatcagccttactgccagaccatggccgcagcccggacagaaggcgctgtgtgcaaatgtcactgtttcaggagctatcatccgcatcttacatatcctccttcttcagccattcttctatcttttctatgattttctctgattccggtatttcaaatatagatccatagtgttcaaccggtactttgccgtttactgcaagcctgatgtcatctgtcatctgccctaatatgttgatctccaccgataggaacagctttgcgtttcccgccttctcaaatgcctttaccgggaacggccacaaagtaattggccggatcagtcctacttttaaccctttgctacgcgccatttccaccgtctccagacataccctggagctgattccgtaagcgaccaggacgatctctgcgtcctccacctggatgttctcatatcgctgctcagtctcttcgatctctgtgtatttattcagcaggtaagattcataatcagggtgtgtataatagacattctgtattttacggtgctcatccccctttttgcatccctttaccgtccaatcaaatttgtcgatatcatgttccttgaactccggtatctctaccgcctcaatcatctgtccgattgccgcgtcggaggcaatcagtaccgggtgccggtatttttcagccaggtcaaaggacacttccatcaggtctgcattctcctgcacggaagccggcgccagcacaattgtccggtaatcgccgtgtcctccgcccctggtcatctgccagtaatccccctgtccctgggaaatatcaccaaggccggttccaattctcatgacattgacaatgactgcgggcaggtcagctgctaccagataggatatcccctcctgctttaatgaaaatccggggccggatgaagtcgtcaaagcccgtgctccggcggcagccgctcccagcaccatattgatgccggagagctctgattcagcctgtacaaattcacctcccacttcttccatcctccaggaaagatactccagtatctctgtctggggagtaatcggatatccgctgtaaaaacggcatccggccgccagggccgcctcggcaagagcctcatttccttttaataatatcttagacatagtttccctccactatcgtatttcaaacacataatccggacataccttgtaacatatgccgcatactatacatttactttcgtccacctggatggaattgtaaccatttgcattaatgaaatccgatacactgaccgcatgtctggggcatgcctcaatacaatatccgcaccctttgcatctcgatacatctgtgtaaactttttctaacttttccataatcaccgatcccttatccttattctttactttgctctaccgcttttaacccaagacgtctgacaatcacagcaaatgacgctccgattacacagctgactatcaggaaaatgaatatataagtatatccatgtccgccgaatttgtccaaaaaaccgccgaaaataagcgaatacagtgaatccggcacatagccgataatggacgctattccaattgccgttcctgtcagcatacgcgggatgcccgcctcactcataaccgagaatacaactccatagagcatcatcgctaccgcactcggaatcaatgtgtaaacacttgccgccgtaggattgatggaggccggaataaataatacggatgcaaacaacgccgccacaatcaggaaggacgttgtcagccatttacaggttgacttaaatactttatctgcgagaagaccgcccaccggagccagcagcatcaggccgttacggatcactgatatgaaactggaatctgccggcgcaacgccgattacctcagtcagatacggattgaagtaagatacgcttgtatatataccgtctccacagaaaataacgaaagaagcaatccacacaatcgggcttcttaagatcttcccaacatcggagaacttgaatttgtcttcatcggcatcagccgctgcgccgctgttaccagctttgttttccttcatcagcaccatcaggaggattcctgcaacaattgctatggaaccgccggcaagaaccgctctgaagaatccggtctgcagatcaccgccagctgtgttaaagaattttaatgcaaatgcgtttgtcagcgcgttggtaattccgttgcaggcataatacagaccatacatgaatccctgttcctcttctgttccgataattctgacagctttcatcagcgaggaccaaaatacaaacgccgtggtgagcgacagtgcaagccagatcatcattgatactgcaaagctcttcatggtaaatgcataaatgtatgccagcaccgatgtggccgccaatgagataacaagcgcctttttggcagaaatcttatctgcaagaattcctcccggtatgtaaagtatcatatttgtcaccgtatacatcgtcattaaaagacctgactgcgtattgctgattcccatactcgcaatctgtgcatcgtaaaaaacgaatttgacatagggaaggaaataaatcgatcctcctgccagccccaacgcaataacggtcaaatactttctcattttagaattcatagtaacctcctttttttcatctgttaaaaacagatcctcctttagaataccttaatctgcagctctgctgcggatccgcccgcacgggcatgtgttacgggatgccctttgggtataccttttcttacgtttcattccctttgttattccttcccattatttataaatgctttcttttttctatctcccccctctctctgttctctattatagaacttcgttctatttttgtgacatttttttacttggtaaaaataccaagtaaaagatgtcttatatatttgaatacagtatacccccattaacaattaaatgcaatattgctttttcatttttactttttttatgaattataaccaattcgattatagtagtttctcgatttcacgtccatagcgtttcaaaattttagcaaattcgtcaattttatcaggttccatacgcagtgatggagcactgatgctgattccgcattccaccccgccattgtgattcataattgcaacgccaatgcatttaacgccaagaacaatctccatgttgtcaatcgcatatccgtttgcacgtgccaattccacttctttccacagccgtttcttatccgttatcgtatagtcggtaaaaggcttgagttctccgctcaatatccgctcaacatccctgtccggcaatctggacagcatagccttccccacacctgtacaatgcagcttcgcccgttcgcctgtaacagggcctgccacggaatacctctgattcataggatagacgacgtccagatagaggacctcatcctccttgagaatagaaagataaaccatctcactggtctcttccgcaatccgctgcagataggggagtgcaattttagaaatactcatattctctttcagggccctgctcagggaaaagatcgctgtccccagcctgaactttcctgtctcgggatcctgctccaggtatcccatatttttaaacgtgaccagaatattgtgaacgttgctcttatataatccgagctgctggctgatctctgtaatccccaaaggctgcttgtctataaaacagttcagaacttccaatgctttctgtaagctttttactttgacatctttttcatctttcatagtaatacaccttttcctttttcttatctcttaatatattactttttcagggtggaagcaactaatttttctacggtgggggaggaggacgctgagaagaagggagagtaaagctgcgggagctgcatatggttcatctgaaagaaccatactgtaagcagccagccctccgttaacgagacggaagcccgttcactagcttcacacactgatacactgtttctgcaatgatctgattccctctggcattcgggtggactccatcagcgaaatactccggatggtcttttgtcacaccgtaaatatcgataaccggcacttcacagttctcccctacccgttggatgatagcatttacttcattaccaataaccattttatctacgccaaatgcaacttctttcttgccgtctgtggcaaaggcatcacagcatgtcatgagatatacttcgggttggctggggatgttctggtacaagtccacgaactctccgagctctttttcatatgccgcggcgtcccagttatttggcttcgaatcattcgtgcctaacataatcagaacaatatcgggctctgcttcctgcgtttcttcgtaaaaatcttcttgtttgtatggcttattacctccatcaagcaaagtacggccgctcagcccataattaagtacctgatagctatcccctagtaatttctgtaaaatggcaggataggaatctatttcccgggtagaaagtacgcctgctccatatgtgatactgtcccctatgcatgcgacccttatctttttatcttctgttttttccgtttgctctatttggggcgccggtggttcttttactttataaacaaagcagaaaagagctgtgcctgcagccacaagcaatgctgcggcaattataataattcctttgatgaccttattcattttccctgaagtccttccctttttctttccgcagacagaacagcgtacccattttatttcctgcattagaatattaactttctgcaattaactttgacgcgcatattttcatatgattattcaccgttagaacaccccaagtctttttgttggcaggtgaagccggcggtataaaaatagcttctgcaattatattacttttaattttccctagattggtaatgctataaccgttttgggaaccatatccaaacatatttcttcctacaaatattcctgctttacttccaaaatctcctaatgcagatattgcaacagcgtcaattagctcaggctgcatatgtatataacaggcaagcacaagcatttctttctgcgggtgttgacatatatttaggacttgtgacgatacgcgctttgcaagggaaataacattttccccatgcttttttacagaaacgctaaaagcagtggaataattccccattgctccttgtctgtaacatttgatctgattacgaatatcggctgcaataaccaccttatttgtattttcttccaacatcatttttgcaatcagccagtcatttacggtaacgcaatgttgtttgcataaagtctgtatttccagaaatattcaaatcatcttgtatttgataaaaaagtctgccagtatccgtttcctctgcaattaaactttgcagaaacgggtgcgctttttgaagagtgtctatgctttgccttagcactccttcatcatatttacattctatttgtaccataattccaaaatgcatatttgggcacataaaatgcgcacgttctgtatacacataatttttaaccgatttcatacctattctccgattcattttcattatgatataacttgaaacctgcacatgcttctgtaagtaactgcctgatttcttccggtgggatattcgttgtgttcgtagaaacaatcgttgctataccatgtgtaaatatccatgttttcacaaacacttccggttcaatcggaacgggaatgtattttgccaaatcgtaaagactttcaagcctttttccactatctgacatacatagaagatgaaacagatttttttctttttgtgccaattccacatactttattcccatgcttaaaaaatagggggtttttgtatcagaaggcggttgcagcatggtttcctcaaagagttttttggtttttttgtatacttcttcctttagttcttccatattgcgaaaagcatgaaacactggctgagtagagcattttagttcgctggcaagcaaacgtgcggttactttttcaaaaccatatacttttgtcaattcaaatgctttttcaataatggcttctttggatatcttaactttgggcggcataatgaactccttttaaataactaagatatatatcaatgttattttatactgtacaaagatttttgtcaattactctgattgattgttcataaaaatgatacgctattgcaatgaagtgaggggcggcagcactacttgctgtcgcccccctgattacttggctggttttactatcttctggaaataacggaatctatcagaccatattttagtgcttcttcggcactcataaagttatctctatcggtatctctttcaatttcctcaatagtgcgccctgtattttcggataatattctgtttaatctttgtttgtttttttgcatataatcagacattatttttatatcgctggctggcccttgaataccgttaccatgcatggccggctggtgtatcatgatttcagcattaggtaaagccatacgcttgccatgtgtacctccggctaacaagaatgcaccaaaacttgcagccataccaatacatattgtagagacatcacacttgatgtatttcatggtgtcataaatcgcaaatccggcagatacagaacctcccggactgttaatgtataaatgaatatctttctctgggtcttgggcctccaaaaagaggaattgtgccacaattaaactggcagaagtatcgcttacttcttctcccagaaaaacaactctgtctgacagcaaacgtgagaaaacatcatagctgcgttctccccggctcgtctgctcaatgacgtaaggtattgtactcatgctgccatctccttgaacatactgatgaatagactacatcttgtgttatagaaattcccacaaagggaaattctgtcttgctttggcacaaacacccccatacttctataaactttgggcggatataagtataattgcttaaaagcaagtgtaaatgcttgttgagagtcatagccagcttcataagcaatttttgtaatcggctcgtttgattttatcaatttttcagcagccaatgtaagccttcgactttgaaggtatttataaacggtaattccagtacattcggaaaatatgcggttaagataaaattttgaatagccagcatttttagcaattttatctacgttaatttctttctcaatattatcctcgatataattcaagaccttacctacaatctctttttgcagttccatagtttcgcctcctttttatcattataacaagtttcagattgtgtgtcttaataaaaagtgcggttttggtgccaaatacggataaccttacaagcctgccgcgccgatcacgtatagaattcggaaataaagcttaaatttaaaagaagcagctatggttttccacagctgctcacgttattttctttttactgttagacttccttttctggaaacaggtcttccagtgcatgttctacgcgttccatatccgcagtaggctcaaaccggtcaatcacagttccgtcgcggttgatcaggaattttgtaaagttccattttatgtcactgctgtttttataatccggttcctctgctgaaataatctcgtgaagctttccgcttaaaggatgcccttcatcgaatccctgaaattctttcttttctgttaggaaccgataaagcggatgcatattctcaccttttacgtcgatttttgaaaaaagcggaaatgtaacgccatagttcattttacaaaattctgcaattttactctcatcttccggttcctgttccttgaattggttgcagggaaatcccaggatttcaaatcctttttcatggtattttttataaagtgcttcaagcgcctcatattgaggtgtgaatccacatttactggctgtattgacaatcagtagaatgttgcccagatatttctccatactctctttggttccatcgatcctttccagttctatcttgcttaagtccatttcattttttcctttcctgcgcttactgcttctaattccttcactgttaattactcaatgcagtattagtatgtccttttaaagtacacataatacgcagccaacgcagcaggataccagaaaacgctcttttaatgaagaatcttcacttatctcgtttttactccacaggggatagtatatttttcgtccctcctttgcaatttccaacagccggttatatccgtctgccatgctatgcgcattccagcaggaaacagccgcaaattattttaatgtcatttccgacattgggccttccgatggtattatgattgatccataatctttgaattccggcaatgcactgatttcttttaatgtgaatgcagatgttaccatacagatctccttccctcttttgtactctggtacacttctgaaacatccgtccggaagtgatattccccgctgcctttttcatagctctgaccgtccggaagaacgataactgcccttgtattacagggaatttctacagttaattcaaaaatatttcctttcttctcccattccgaaacgatatccccatattcagacttaaaggtacgtttcgcccaatctaaacgctcatctaactgcggctgaatcagaatctttttaaatcccggctccacatagttgattccgtttacgttacggaaaatccagtcatccacacagccaaatgcataatgattcaggctcatgcagaatgtcattccataaatctccgatataaatggtgtgccatcttcgtccaaagcaaaccagctctcccagatggttgttgctccgtgttttacctcatacagccacgacggcgctttttcattaaacagcagatcatatgccagatcccggcgtccgatttgacacaatgcatcctgcaggatcggcattcctaagaagccaacatccaaacatccattgttctcttctatcttgcgcactaagttttcagcaaacttcttcattaagtcttccggtactaatccatagtaaatcggcattgcatatgcccccatgaggtcggccggcatatttccttttttgtccaatacgcctttttgaatagctgttttcatgttctccgacattttggcataatattgtgcatcttcatcattcccgagaacttttgctgtttctgacatgatagatatagaataatagccataaatgggagccacatatctggttgatacacgtattgcttccagggtgccttctccatatccctccctggaataacttgggatcagatgttctccgtaatgatgcccggtattccatagatattgctcaacttcctgcggaagagtactatcccccggtcgattttctcttgccgtcctaagaacaaaattacaccaatttttcatagaatcatattgctgcttcaggatatgggtattaccggtgaggcaatacatgtaatatggaattaatacagctgcatcgccccagcccgcaggggaaactgcgtccggcgttctgaactgttcttcgtacatttcatactgtccaatataagctcctgccaatggtactacaaacggcactgatccatttttcttttgttcacaggcaagattttcaagccatcgggttaaaaacggcgtaatatcttcattcaataacgcagtttttgtatatacctgaatatcgcccgtccatccggctttttctcgctgcgggcaatcggtcggtaaggacagcatattcgcatgctgtgaccagcgtgtattctcatataacctgtttaccccgtcattagagcaggaaaatgtccccacattttgtttttcggagcttagtacaatcgcagtaatatcttctgctttcaattcctctattccgtcgatcatgacataccggaatccttgaaatgtaaagtgcggctcataaacctgtgcagttccatcggagatgtattcaattcgctgatcagctgtcggattattatcaaagaaattcccttctgcatccagcccttccgtatgaatcactgtcactttcgtatcttttggtacttgaatataaaggcgtacgcggccggcaatcacctgaccgaaatcaataatacgttcgcctttcggtgaggtcagcattcttttaactggtaatttcatgatgggacgcactggctgtccatactgtgcttttaaattaccgtatccaaaatctgccggtataacactctgccagccgctgtcattgaaaccagagctttcccatccgtacggcatcttatttgcatcataaacttcaccagcaaaaagatctgaacaccgaactggactttcctgcacttttattgtttcatccgaaacgaagcaccccgtcgttccatcctcgtatgtcacttccagctgcgtcaatatggcatacgccggatcgtagctctcgtcctgtgcctttgtcataaatccatgataccagccatcccccgtatgcattccgataatatttgttcccgtatgtaaaaactctgtaacatcatacgtctggtagcaaagatagtctctatatacggtacactccggcgcaaattctctgtcatcgggacgtttcccattgactgtcagccgatagacgccatgacaggtggcatagagcctggcctctttcacttttttgtcaagcatgaccttctgacgaaacaacactgccgagggctgctcccccaaatgagctttacgctccacggtggaaaacggcgattttacccacttcgcccgccactcgtccctttttagaaatgctgtttcaaattcgctgaaagcttcagcctggtttccatgattatcctctactctaattttccagatataccgggttctgctttttaaggcttctcctctgtaatccacatatacagactgttcagaaacctgccttgtgctgtcccacacaatcctgttttcgttgtcccgcacctcaatctggtatgaatgctgcaacacgtttttttcattgctttccaaaatccaagaaaaatatggattcctgtcgattcctattgggcgtaccagatgcatacatttcaaatccttaatttttagcataatgttctccttttaagactggtaaaatcaaattcttaatgtcctatacgagtttctaatacgatcatctgatttcattttctactttcatatttgcgtaaataacccctgtgataatagaaaagataagtgggaagccaagatataaaaagttaatggcatgattagcggcagcagtctgaactgcagctgctccatcaaatccactccaggtcagtatccatccgcaaatagcagttccaagtccctggcctatcttagttcctactgtagcacaggagaacagagagcctgtaacgcgatgtcctcttttttgaaagtgatattcatcggcttttactaaaaacggtgtataagtagcagaacccggaaccatgccaagcgctttaattaacagaccggcaattagtattatcattcctgtaaactgccctaaaacagccacagtacaccctgcaaccgaaacaaccgtaccatagacacaagccttccgcatgcccagtttgtcaatgagctttggcataaacggaagccccagaattagcgggatcgtcgtacacattcctaatattcccataagaccggcatttcccatggagtacgttgcatagtaagccatacttgattgcataataccagaattagcatatcccacaagatacaataacaggattaatatgaagtatttattctgcagtaattcaataattgtccttccgaaggaaatagataccgtctctgccggaacaccttcacctgcttccaaaacaggagatccgaactcttcttccggtagttcctttagtgtgaaaaacgggattagcaggatcccaacacccacaaccgcataaattaaagcaatcatccgccacccctgttgtccgccgccgaatgcttcgaccagaccggaggtaacagatgctacaattacactgcctattgttccactcagcatagccgcgccgctcatcgtaacctgatcatgctgatccttcgttacacgcgccagcatcatattgtaggcaacctgattcatcgtatagaaaacagcgctgatcagcagataaaagagaaagatccacgcactttttgcgccttctcccagcgatcccggaacattaaaaatcaggaacatgcatacgcccataggaatacagctaagcagataccagaaccttgtttttcccatcttagactttgtaagatcaataatcctgcccataaagatatctgtaataccatcaaatacctttgcaaacattagaagagtcccgataattgcagcgctgactccgatgacattcgtacaataaagtaataaaaatgttgttattgtgccccaggtaaatcctccccctgcatttcccagtccatatgcaatctttttccacattggcaatgaacctgttatttgtttacccatctttcttcctccttttttctttacatctcttaattacaggttcatcttagattttatttgcctctgccgcaatttatataatccgactttacaatagatgtaatgactttaatccgacattttattgcttttttcatatagcattgttaaaatatgagtaaataataatattccgatcgcattggaggaaatgcatttgaaacagattttagaatacgtcgaacaagtatttaaacgcgaagaagaaaagaatctgaaaaattatgcagcagagcatttacactttacccaaaagacccacacctggcagccatatagttcggaagggtatatagataaagtcctgcagattccctatgactactttatgacgatcgaatactgtacccccacccaggagaatggctatcttttgtctacatactcaccatgtcctctgcccgtatcacagaaaacttatcttttggaaaataataatgaagatgataatttacaccggcacgattatttcgaaatgatctatgtttataaaggcacccgcacgacacagattgaaaaccagacaatccatttagccgagcatgatatttgcattttcgatacccagtgtgctcatcttgacattcgctccaaaagtgagggaattgcattgtactgctgtataacaagtagaatcttagactcctatttttttaagcatttaacaaataaagacatacgagatttttttttaattaaaagtaatgttaaaagtgatgtcagttatttaaagcttcatgcaacccccggccattcaaaacagatcgaagaaaatcttgcagctatattcagtgaaatggaatcaactaaagccggatatggaaggattgcccaaatacatacattaaggatcctgaatgccttcgaacacttcaccactaatgacatctacactttttccaaacgccttcagggaaataaactatttcaggctgttgcaaaatatattaacagccatatagctgatattagtttagatcagctgtgtgaccacttccattaccagtctgattattacagcaggcttatcaaaaagtataccggcttaaactattctcagtatgtgcatgctttaaaaatggataaggcaaaaaatttgttagtaaatactgatatgtccgtttatgaaatcctgatatatcttgggtatcagtaccattcctatttttataaatcatttcaacaggaaaccggaatgacaccttctgattacaggaaagccaaaaaaggggaactatcggtttagttccccctctttaagcgaatcaaagtgcccgcttcattattcaccgaattcatcaccgaataccggttctatgtactttttgataaattctattctatctttcgccttaggcgtaaacatggcggttatagccactacaattttctttgccgcattcacgtagatgacgttacccccatcgcccattgctgcatacccctcttctttttcacccaccagccaccataagtacccatagggcagattctcttctttccagcggctgtgttcctttgtgctttcttctacccattccctggaaacgatctgtttgccatcccagatcccgccggccaggtacagctgtcctatttttgccatgtctgcaggcgaaagggtcagaccccatcccgcggaatttacaccggccggatcagatacccagccgctgatgtccgtggccttattaaatgcaaactgttcttctttgctttggaacgtaatactgcgctccacggtaataccgagcggtccgaataaattctccctggcgaaatccaacacggtttgtcccgttgttttcatgagaatcccggttagaatatcgggacctatgagaggcgcatatctgaaatcacctatgtttccccgtcctcccagatagtccagcccaaatgtcacccagtcatcacttgtaaaatacttcacatagggaccagacctgtatttatagggcgctgtcattgtcagcagattttcaagcgttatattctggattgttttttctcgtttcttcactgtataattggggaaaaagtctagtaccttctggctgacgcttctgatgcatcccttctctatggcaattccgattaatatggaaatgatgctttttgtcacggagtatacatgcagacggctctttgcagtacatccgttaaaataattttcataccggacctgcccttcttttagcactacgattcctgccgtattgctataatcagtttttattgtcttctcaaattccgccactctttccagattcatttaacctctcctcttttctgcttttatttttaccgggtagtaaacttccgtaataagttcgctttcatccgaaacctgggatggatccgtcacatacacttcatataaagcattgctgctctcatacccttctttttccgcccattcacgctgttttgtatacacagaaggcaggttggaatatgagccgtgaagaaccgttttcaggcacaatcccgggcaaaaatccctggtgccggtggcgtattccctcaccggtatggcaaattcagtatccaaaccaaagggactatattccgcgctgtggaaaagtaccataggcggcgcagacacagtcaatcggtccgcctcaatcttccggaacaatttacgatagcagtttccatattcttcggaaaattcgtattcattcaccattttccggattgacaaaagatacatcaccggcacttccgtaagctgtacatcgatcgtctccaagaaggacatcattgatttacccgccttcagatttgaaatatcactatttagctgttctaatgtctctttcagttttctgctctggtccccgatctctttcatcttcctgcagagtctaatataaagcatcgcctcctgctcttcttcagattgaagaatctcaccgatctcctccaaagaaaattgataagatttcagacggttaatcaataacatcgtttccagctgatcaatagaataatatctgtaaccggtctccgggtttacctcattgggcaggatcagccctatctcggcataatagcgcagtgtcttcgtggacactttgcatatgttagaaaactctccaatcgttaacatccgttttccacctcttggtatgtagaaaatctaccctaatcttacaccttgccctacggggaaagtcaagatgggaaatttagagcaaagggatggagccgttactgttcacggggccgtgcaccttgctgcacggcatccgagccaataaagtgatgggacgggcatccggctccccgccgcaggcgattttatatgtgccataggccgcgcatattaacatggagcttgttggggcggcaaagtctgcaatatatatgcaacttttcagattcaacttcgcaagcatttcgcccctatacgccccttcctagtaccacagcctcgtatggccgcagggatcgtgcgcaatctttataattccccagaactttatgatacccctcctgggaaagctcctccaccgccacttctctgtccctgaagttacacagtacaagcagttcttcatccccgcgtgttcttttatatgccagtacatccgggttttcctgatgcaggaattttatctccccttcggctattaccgggttttcttttctgagacaaattaacgctttgtagaaactgaggatcgaatctttgtctgccgcctccgattccgcatttatggtattataattttccggcaggccgatccacggagacacctctgagaaacctgcgtttttcccatctgtccactgcataggggtacgcccgttatcacgggaacgcgccgagaggatatccaaggcttcttcatggctctttccctgggacagcaagatttcataataattcaagctttccacgtcccggtactgggaaatatcccggtatcctgcgttggtcattcccaattcctccccctgataaatgtatggggtaccgcgcatcagatgaatagccgcggccagcattttagcggattccttccaatactttttatcgtctccaaaccgggatatgattctcggctgatcgtgattgcaccagaataccgcgttccagcctccggctttctgcatcccggtctgccattcttcaaaaagacgtttcaatgccattatatccggatccatcagctcccacttattcccgtttttgtaatctactttcaaatggtggaagttaaagcacatagaaagctctttttcttccggattagaatagcggatgcagttatccaatgatgtggaagacatctctccgacggtaaccagatcttcaatcccggtatcatgaaccagttccttcagaaacttatgcacgtgcctgccgtccgtatagaatcttcttccgtccccttgtgaatcgtcctcgaatatttgcggctttgatatgagattaacaacgtcgaaccggaatcctttgatgcccttttccttccagaaacggatgacttctttcagttcctctcttactctcggattctcccagttcagatccgcctgtgttacatcgaacagatgaagataccatttttcaagatgaggcacatattcccatgcggagccgccgaatttggacttccagttcgtgggcgctttctccggggagccatctttgaaaatataataatctatatactctggatcaccctccagcgccttttgaaaccactcgtgctctgtggaagtatggttgaataccatatccagcatcaggccaatcccccgcctgtccgccccggcaatcagtttctccagatcttccattgttccgaacagtggatcgatgttccgataatccgccacatcatagccattgtcattctgaggcgacacaaaaaatggtgtcagccaaagataatctacgcccagttcctgcagataatccagcttttccaggactccgcacagatctccaactccgtcccggttcgtgtctttgaaagatttggggtagatctggtacactattttatttttaaaatctgccatgtttcatgcctccgttttttctaatccttatttgcctgctctcattatgtctgtttcatcctgccgcattcaattccaataggttacaaccgccgtttcacctgatgctgcccggcctcccgtatgatactggatctcttttgcatctccttctccagtaataatgcaaaccgtcacgtccggatggcccgcagcttttatcttctccctgctgaatctaataagaggggttcctgttgtaacatcctcgccttcttttaccaggtattcaaatccatcgccctgcatatccaccgtatcgattcctatatgaagaagcaattccatgccattgtccagcgtcaggccgcaggcatggcgggaatcctccatgagtaccgtcacttttgcgtcagccggtgcacagagtgtttcactttccgggagaatggcaagtccgccgcccatgattccctctgagaacacaccgtctcccacttcttttaaagagaggacttttccgtctaaaaatgccttcagttccatttctttgtgtgccttatccctggatgtttctgtgagagactcttctgaatctatatctccccccagtattccctccgcctgcacatgaatgacgtgtccgtcatcctctccccttacttccggggaatcttctttgtttccggctgatgccacgccctttttctttcctgcaattatcgtcagtacaaaaggtactacaatcgcaatcaccatgcatacagcaaaggagagcatatattgaggcttgatggaaaggattccggggattcccccgacaccgatcgcatttgccgttgttccggtggccacacagataactgccgcacaggcggaacctatcataccgcatacaaatgggaagagatatttcaggtttacaccgaagatcgccggctctgttacgcccagataacatgagatacatgccggtacattcacttcctgtgcctccgcattctttctctgcaggaagatcatcccaagtactgcagaaccctgtgcaatattagagagtgcgatcatcggccacagcatagttccggtgtaatccgcaatcagctgcagatcaatggcattcgtcatatggtgaagcccggtaataacaagcggcgcatagacaaatccgaagaccgccccgaatacaaccttgaacgaaccggtaattcccgcatatacgacacttgaaatggctgagcctatcttccagccaaccggtcccagtataaaatgtgctgcaatcacagccagcacgagactgcagaatggtactacgatcatggagatcacctgcggcgtaatcttccggaaaaatttttccaggtatacaagggtaaatgctgccagaattgccggtatcacctgtgcctgatatccgatcatgtttaccttaaaaaatccaaaatcccaaaacggaatgtctgctgctgccgtggacgccacggagtaagcattcagaagctggcctgaaaccagcgtcagaccaagaacgattcccagcatctgagtggtacccatctttttggtcactgaccagcaaattcccaccggcagcatatggaataccgcctcgccgatcagccagagaaaattatctattccggaccagaactggctgatatcacacagcgttttggttccgttttcaaacaggtagagactgtcgatacagttgcggaaccccaggatcagacctcccacaataatcgccggtatcagaggcgcaaagatctctgctatcgcagccactgcgcgctgcaggagattctgattgctcttcgccgcctgtttcacagcatccttggataccccttcgactccggcaaccgcaacaaaatcattgtaaaaatccgccactgcgttcccgataatgacctggaactgtcctgcctgcgtgaaactgccctttacaaccttcatggcttcgattttcttcacatccgctttagactgatcgttcaaaacaaaccgcattctcgtcatacaatgagaaaccgcggcgatattcttctttccgccgaccagttccaaaagctcttttgcgtcctctgcatatctgcccattactcttcctcctaatcttaacatctgttagattttgcttttacatatctgtttattcactgtctgccctgtcgctgcctaacttgttcaaacaagtttctttaatcattttatatcacacttgtttaaacaagtcaagcgtttttttataataactatggacaggaaggtcatgaagaaggaatacagattttgatagagttttgctataaaatgaaattttccagggaagaaacgaaagctaaggtggcagacaaatttggtctggagccgatgaaggctgtaaagtacatggagaggttctggtaaaattctgccactggttgaggacgcaatataatagggacagccatctgcccctaaatcaggatattgcgacggccatctgtcccggcgcggctccataaagcaagcgttagaggctgtagaagaaaacggaacgggaagggagggcagaattttgccttacctttccgttccgttttcttctacagcttcttcgcgaagtgtcaggagatttcaccagcagacattgctccgccaggttccgggctcacctcgccattcgcgtcccccatccataaagttttactcagccggccctgccgtctgatgcatgcccagaggcttcacattaaagttcgaacggtattctgtctcatcccagaaaatatcctctgccacaagacactgtggattcaattccaccccgtccagaatgatttctttaaacttcttataacccgcacggtcaatcagatggccgccatgaagatattccggcttatagtccataacccatgcggagaacttctgccagttgctaagaactgagaggactacatcctctgttgcccagttcaggaacatcttgccggtacgcggagtctggcgtcctgtcctgccgcctaagattacgcggtaatacttcgtgggctctctggtccatgcactggttggacatgctctgacgcactcgccgcaaccgatgcagcagcaggcatccttctcgatctttccggtatcctcattgagtttcagcactctggtagatgccttttcacatgtgcgtgcacaggcgccgcagccaatgcagcgttctgggtgataaaccatacgcgccaccccaatgattccaaagtcgcacaaatgtgccttattacagtcattcgggcatcccgcaatattaatcttaatgtgataatggctagggaatataatgggttctatcttcctcgccagttcatatgtattgcagtttccacagatacaatggtaatttccgatacatgccgtaatattccgtgcaccgattgtcgggtatccgctctttggatcccattcctgaggctcatgcgatactgtgtccatatctacctggcaaagctttgcatccacctctttgatatagtcttccaaataagcattcacggccggaacattctcataaggaatgccggttatgtcaaacgtctgcctcgttccaaagtgaaagttcccatccccccaagtcttcgcaatatgctcaatcactgaaaggtaggaggaatcaataaaacctcccggaaccctcatctgcagcataaactgtccggggactttggactggcgaaagcagttaatccgcagttttttaatattaatatcctgattcataccagttacactcctttctcaatccaccaagtcacgggctgccgtatagggaaaaacaggtccgtctgtacagacatagacctcatcaatcctgcagtgcccgcattttcctatggcacatgacatcttccgctcaaaactcatccagaccttctccgggtctacgtcgtatttcatgagttcaagcccggtgaatttcatcatcggagggggacctactacaaccactgcatagtttccctgaaattcgtcgaatgggatctcttttacaaattctgttacaaagccggttctccagccttccttcctatcggtatccagcgcataggtcgtaacaaactgctcctcccacttcgccagatccccgctgaaaatgattccttcctcattcttaaagccagaaataagatgcacgctcttaacgtattccggcttctctgcaaaactgcggagcatagaacgcactggtgctaagcccgttcccccagtaataacgactatatgtttcccggcaaattcatcgacaggccatcctttgccataaggtccgcgtaagaacagtacatctcccggctcctttgaaaaaatacagtctgtcactttccccactgaacgtatcgtaaactccagccatccctctccctgtgccgaaactgagatcggagcctcaccaatctttgggatagacaactgcataaactgaccatgagccggacagacatcagaagcgactctgaaggtccactcatgctcactttccttgtgcacatccataattgtacacggttttggcataacaggattcatcataacagtccctcctttactgttccatgccggcttttatctcctcaaccgcacgattcattttgttaacagttgcactaatcgatatcatttccggacaacggtgcgtacagcggccgcagcccacacacatatgggaatccccaaaccgcgccttataatcataaaatttatgtaagaccttgaaacgcattctgtccgccgcagtactgcgcatttctttctgtccagccatctggtcgaacccttccacctgacaggatgcagttactctgcgtcgctctcccacttccggattgtccccatagagaatatcccgtgtcgtaaagcaggtacaagtagaacatgccactgtacagctgccgcaggatgtgcatcttccatcgaattccttccacatcgggtgtttcttaagcgccttacgtacctctttatccgacagatccggaatcttgaccttcagctcattctcctctacgaacaccggtgtatacctggtatcaggcatccctttaaaataaggctgaaaactctcatctgtcacatgaaccttcaactcttcttttgaaaatttaagagccagtgagtagtcatccgtccggttcgttcccattgaaacacagaaacatgtatcgtctcctccattacactccatcatggcgaacttaatccgctctctgacacgctgataatagaaatcctcataccctccgttaccagcaaatatctttgcctgaatgtgctgtgcattgatatcgcagggacgggcaagtatcagaattggttttttaggtcctttactctcacggtactcatcttccgtaaaataaagaattgtctcctggattggattgataacctcctttgcaggataatctgactttgcatcccatacaatctcgctgaaataatccacctggtcataacggataatgtcggtatccgaaaaacgcccttctttttggaaacgcttcggggcataaacgcagtagtcctttttgagtgcgcacagaacctcatcggcctgagcggtattaagtacataatccattctgaaaacctccttttcattgttgtcccagagttcccatttagacttgcctgaactgttttgttctagaaattttactgtttggtctgatcagtagctccggtatcacattcctatttattttaccattaatttactataacaaaaaattatttattattattatataataaaatataattatcattactatttttctctccgcaggtaaacaccaaccgttactatgcacggccaataagccgtgcatagtaacagcatctggctcatttaaagtcgccagcggcgagaagccagatgcccgccccatcactttagtggcccggatgccgtgcagtgtggtgcacggccccgtaaatagtaaacaccaaccttccctcacaaagacttgacatctctgtcctatgatttataataaagctagatgtttaaacaagtatgctaatataaaggaaaatataccatgccaaaagcaaaatttgaatcgatttacaaggatctgaaacaaaaaatagaaagcggtgagtacccttatcaggatctgctgccctcggaaaatacaatggtaaacatatacagcagttcccggaacacaatccggcgtgccgtcctggaactggctgaacagggctatgtacagtccctgcacgggaaaggagtccgcgtaatctatcagccgatcgatcaggctgattttacacttggcggaatcgaaagttttaaggaatccgcagagagaaaccaccggaagacttccacgaaggtcattcagttcacggaaattacggctgatgcacgggtgtcagcaaacacaggctttgcgccgggcagcgagctgtattacattcagcgggtccggtatctggaggacaaggcgctgatcctggatatcaatatgtttctcaaatcccttgtgcctgggcttacaaaagatatcgccgaaaaatccatttatgaatatatcgaaaacgaagtgggaatggctattgtaaccagtaagagaaagatgaccgtggaacgtgccactgaaattgacgaaaagtatctggaactgaacgattataactgccttgcagtcatcagcggccagacatttaattctgacggaatcatgtttgagtttacccagtccaggcaccgccccgattatttctgcttccaggatactgccaccagaaagcggtagctagtacatcgtataacatctgaaaggagttttagacatgtgcggacgttattatattgacgacgagacagcccgggagatcgaaaagcttgtccgtcatctggacaggaaaatgtctgtttccgggaaaaaagacatctatccgtccaatacagcccccgtcattaccgggcatcacaatgaatttgcagaggaactgtttacctggggattccccggattcggcagtaaaagcctgctcatcaatgcccgggctgagactgctatggaaaaaagaacatttaaagacagtgtacgtaccagaagatgtgccgtacctgcagcggggttttatgaatggaattccgaaaaagaaaaatatacatttcgtaacccggacagcagcatcttctatctcgccggattctataaggaatacgaggaaggaacccgctttgtgatcctgacaactgaggccaatgattctatgaagagcgtacacaaccggatgccgctggtccttggccggcaggagctggacgcctggctgtttgacgatagccagacggagctgattctcagaaaagttcccggccccctgaaaaaagacaccgaatacgaacagcagagcctgccttttaccaacatgtagacagatctgcctgacattttccctaccgggatggcagtataggagatgaacattatggaacaaatgaatttatttgatgaccgcaggcagacggcccctcttgccagccgccttcgtccggacacactcaaagattttgtggggcaggagcatctgctcggaaagggtaaggtcctccggcagctgatcgaaagggatcagatctcttctatgatattctggggccctcccggtgttggaaagaccactcttgccagcattatcgccggacagaccaaagctgattttattaatttcagcgccgttaccagcggaattaaagaaatcaaagaagtcatgaaccaggccgagcagagccgtcgcatggggatacgcaccgttttgttcgtagacgagatccaccgctttaacaaagcccagcaggatgcatttctgccttttgttgagaagggcagcatcatactcattggcgccacaacagaaaatccatcctttgaagtcaatgccgctctgctctcccgctgccgcgtatttgtactgaaagcactggaagaagaggatctggtgaagcttttgggccatgccctaataactccgtccggtttcggcggccagaatgtacatattacgcctacccagattgaggccatcgctgcatttgcaaatggagacgccagaacggccctgaacacactggagatggcggtgctgaatggagaaatcagcgcagccggaatcacggtaacgaatgaggggttggagcagtgtatcagcaaaaaatcgctcctctatgataaaaatggagaagaacattataacctgatctccgctctgcataaatccatgagaaacagtgatcccgatgcggctatctattggatgctgagaatgctggagggcggggagaatcccctctatattgcccgccgcctgatccggtttgccagcgaggacatcggtatggcggacagccatgcccttcagatcgcggtggctgcgtatcaggcctgtcattttctgggtatgccggaatgcgacgtgcatctcacacacgcggtcacttatctgtcctttgctccaaagtcgaacgcactctataccgcatgtgaagactgcaaaaaggatgtccgcaatctgcgggccgagccggttcccctgcagatccgcaatgcgcctacccgcctgatgaaggagctggaatacggaaaaggatatgaatatgcacacgatacggaagaaaagctgacacacatgcagtgcatgccggattccttgagagaccggcgctattatcatccgaccaaacaaggggaagaactgcaggttaaaaagagattcgaagcgatccagaaatggaaaggggatatgcctccctcaggagaagtatgaaagtaaaaaaatgtgtaaaagaatcatttgttgtgatcggaaaagaaggctccacgttagatggggatggttttatacagaaattatgggaagatgcgaatggagcattttgtgagatacagcatctggcaaaaaaagatgaacaaggaaatatagcgggaatctggggcgctatgtctgatttcacctattcatttaaaccctgggaagagaattataccaaaggggtatatcttgcgggagtagaatgtgatgatgacgccgctgcaccagaggggtggacgaaatggaacattcctggctatgagtatttatatgtggaatgtgatggttatgatatattttctgaaatgatacagtatatggttaaaaatgagcttccattggcaggggcagtacatgattttacttgtcctaaaaccggtaaaaattatatgttctttcctattggcagagttcagtaattgcagcttgttaaggtaatattcaccgtgaaggaatctatggtgattatgatgattttaatgacgttgaagaattgattgaatttataaagactggaaaacgataaaatttcagtctgcaggatcgggaaatttgaattgatggagatatcttgatgaaagagataattgcttataagttgtcatttaaagatgccttagactaccataatgatatactttgtattcccttccaagaaaaatattgggatgaatacatgcagatttataatgaatgtttctatgaaatgagaaaagatttagagattgaaccaattaattattattctaattattctcaaatgagcgataaaataaacaatacttttatttacctgcaaaacggagttatagcaggggctgttacttgttttgataatgaaatagacgatttgattgttagaaagtcatttcaaaggttgggaataggacaaaagttgttactatggggaatgaatcatataaaagaacaaggctataatgatattgacttacatgtagccgaatggaaccagagtgctataaagctatatttaaaaacaggattcaatatcacgaaaaaagaaaaaatccgttaatttctagtttgctgtctcgtcggttcaaagactcaaaaagaagtaaggccattttcaggttgtggaggatatgaattttgtatataattacgatcacccaatgtttgaagattgtatacaattggttgatgtggtttatctgaaaagagcacgataaatccctaagtatttgaaaattcaacagcatagaaatggggagttgacggaggaattaatcaaatgaattatgaaataatacatgatgtcaaataataaataggtgtttagaaaggaaaatctcatatgaaaagatatattgccttgttaaggggaataaatattggcggtaaaaacaaaatagatatgactgaattaaaagaaggctttgcagaacctggttttacagaggttactacctatcttaatagcggtaatgttatcttttcaagtgctatggatgataaaacggctctttcaaataaagttaagcgaatgataaaagacagatttaatttagatattccagtttttattgttttgcaggaaaaattaaaagacttattaaataacgctcctgattggtggggagatgacaataaagatatatatgataacatcatatttcttatgccccctttatcttatgaagagttttttgatgaaatcggcaatccgaaatcggaatatgagaaagtgcataattacaaaaatgtgattttctggtcatttagccggaaggattatcagaaaacaaattggtggtcaaagacagccagtgcaaatgttagggacaagattacaatacggacagcaaatactgtaagaaaaatagcaggtttgtgatataaaacaagaagttttttatatctcctgttggttacattcagccaacaggaaaagcgacagtgacgattactatcgcttttacattagatcagcacaaattatacccaaagggcccccgtaaattcatgccctgcgggcggatctgcagcttagctgcagactaatatacacttacacaaataacgcagccgcacagtagaccaataagagagccatcacaatattaacaagtcttgcatgttttgaaaaaaatctacagaaaacagtgccaaacagcgcccatacaaatgacccggaggcaccgatcactgccagcacaaccgtaaatccaaccactgccccaatggaatgataaatcgggagtatgtataaagtcattgcagtaattgcataaatataaatcttcgggttggcaaactggagaaccataccagaaagaaagccagcttcttttccaccgcctgcctccagatttgtcgggcttttccacaccttccatgcaaggtacagcatgtaaagcgcccccaagatctgcatgacaggttttaccttgggaagatatgaaaccagagttgcgctgcatactgtacagatggtcataattataaaaaatccacttaaaattcccaaattaaaacggacgctgcggcggaagccaagacgaatcgcgttgctcatagaaagcagattattggcccccggcgtataagcagtaacaaaacaatacatacgggaagagaataaacttagtatggacgagcttgctaagttaagtggtgtaagtaaaagtatgctggcacaaatagagcgtggagaaggcaaccctaccgtatccacgctatggaaaatatcaaacggattgaaagtaccttttgatgcacttaccgtccgtcccaaaacgccctatgagattgtaaaaaccacagacctggaacctctactggaggacagcggaaaagttaaaaattactctctttttccagacgacgaaaaccgcagatttgcagtctactatctcgaactggatcaaacaagttactgggagtcggaaccccatctgaaaggaactaccgaatttattaccatatttgccggaagtattgaaattaatatcgatggtaagaaactaaccgtcggtaaaggagagagtatacgctttaaagccgacagcccgcactcctatcgaaataccggaaatgaaactgccattttgcatatgattctgttcaatccctgaattataaaatgccttccgtaaaaatactgcagggcctctgttttaagatcctatgcatcatcattcaaagtgtaattttaaactggtttttcccctcttcgtaagtatactcaatcgtcccgcccagcttgcccacaatcttccgggcgatggcaagccccagcccggtacctcctttggatgttctggctttatccccgcgcacaaacgggtcaaatagaatggggcgtatctcttctgcaaccgcctccccgtcatcctgtataatcatctccgctcttccccttaattccctgacggtgatccaggcgccctgcccggtctggttgtattttctaatattgcagagaagattttcaattacccttgtaaactcttttttgtcaacatctgccgtgattggagtctccgggatctcaatatgcatctcaattcccttgtcttccagttcttcatagtattcggcgcatactgagcgcaccagctcgcagaggtctgtctgttccagctccagttcatattccggattatccagtttcagcagcaggaacatttcattgaccagcacatccaccctgaccgcctttttgtctataatccgatagcactcttttaagtcttccgtctttaccagtccttcctccagtgcatttgcatagcttttaattgtagcgacaggagttttgatgtcatgggacaattccagcagcatacggtttttcttttcttcgctgatccgtttttcccgcttctcttcttccagtctttccgtcatgaagttaaagctgtcccggatctcctcgaactcacgctgtgcacgaaaatccagccgcacctgatccacaccgtttttaatcacctgctccattccaccggtgatctcacccagcggcctgcgtatctttctggataaataacggctcatcaggaagcaattgccggcaaagaacagtacaaacagcaaaaggaacccgatggtcagtcgcctgccctgttggctgctccctgcattataattataagtcagcgacagcgccttccggtctattttaataaaatagtagaatgattgtccccctttttgcaccgtctttataaatcctctgtaatcctttgccgaggcggccgtttccacaaaattatcggtcaccagatattcgtaaatctcttcctgtgtatacgactccggttcatccagtttgtctccgtatacctccagaacgtgatagtcttcatccagcttttcaatccagcctccatttttttcaagtacactcaggttctggattttcccgctgccatccaccatatcatatggcgccagtgtctcaatactgccgcccccgatgccaatcagtatcccgaacatacatacgttcactccgattacaagaaagacagcaaagagaacataactgccgaccagctgccggaatacgctgccggaattttttcttatactcatcacgtctccctctccatcttgtatcccaggccctttactgtcttgatctgaggcggctgctcgcctgactgttccagttttcccctcagattactgatatgtaccataacggtattgtcatcccccgcgtaggaatcttcccacacactttcaaaaatctgctgttttgtaaagattcttcccggctgtcccatgaacagctttaatatcttaaactccgtggatgtcagctctactgccctgccgtccagctccactgtcccttcctcttcgctgagcagcagaccccggagacggagcacttcccgggtctgctttgtttcttcacggtaatcataatttcttctgagctgcgctttgatacgcgccacaacctccagcggattataaggttttgtgatgtaatcatctgcccccagttccagccccaggatcttatcataatcctcactcttcgcagtcagcataatcgccggaatccggctggcctccctgatctttctgagtaccgcatatccgtccagcccgggcatcataatatccagaaggacaaggtgcacttcctccctccggaagatttccattgcctcaatcccatcctttgccttcctgattccgatatgttccctgtccagataaagttccagtacatccagaagctctgcctcatcatccgccgccagaattgtatacattgctcattcctcccactttgctgtgaatccggtattcccggaataatgccgttcctgtttttggtataaagcaggccgacatatctgctttttccagggtcagcagccgcacctttttctcgattccgcctgcataacctgtcaggcttccgtttgttccgactactctgtggcagggtatcattaaagaaatggcattgtgccctacggcgcctcccactgcctgtgcagacattttgtcaagccccttccgccttgcaatcctgtccgcaatcccgccgtaggtcatcgtctgcccgtacggaatcgtaagcagaatttcccatacctctttgcggaatggagtcgtctccatcaataacggaggtgtaaaacccggctcttttccgctgaaataaatgtccagccagcgttttgcttcctcaaaaacagccagttccttttcttcacagtttttcgccagcccagcgccaaaatatttttgcccgtcaaaccataggcctgtaatcgctgttccattgcttgaaatcgtaatgtcccccaatggagaatgatagtgataagtgtaggtcattgcatgacacctcccaatatgttcttctgcttttttctgaaccatataaaacagcatgtaaaaaatataattccccaaaccgttgcaatcggtgtcgctaatcctacatatgtcagcgatgaacccggcagtcttgacatgaaaagggagaccggaatccgaatgcacagagccgatatgatcccctggaacatgacaggctttgacactccatttccattgaagtatccgatactgctgaacaatatacaggtcagaatacattccgggcagaatcctttcagataagcggcgctctgcgtgataacctccacatcacttgcaaatatggaggaaagaagctctccgccgaaaaagctgaacagaaacataaaaactcctactgcaccgccccccagcatagccgtatagaatccctgaaatgcgcgcttatgttttcctgctccaacattatgtgcgacaaatgcggacacactctgcatcacggaagccggaaccagcagcataaaggatacgagcttctgagcaacaccataccccgccgacggcatcagccccataccgtttacgatcgaattaatcaccaggaacgagatctgtaccgttgtctcctgcagagcaatcggaactcccacccggagaatttttctcagctctatttttgagagcctcatctgctgctttgtaaatgtaattcccaaatccttccgttttagtacggccaatgatatgataaccgataccatctgcgcaaggaccgtggccagtgcggcaccggcaacatccatatgtaagactcccacaaaaaacaagtcaccgataatatttaccacacatgcgatcccaacaaaaagaaacggcagattcgcatttccaacgcccctgaggatactgctgatcacattataggcaatgataacaataataccgcccgagcaaatccggatatactgaattgctttttctaccgattctgccggcacctggagaatctgcacaatatttcctgcgaatacttccaacagtatggtcatgataatgccaagtgccaaaaacagaatcacggttgtaccaaccgtatcccctgcctcttccggtttcttctcaccaatatgctggccgataattaccgtggagcccatcgctaggcttgtaatgataaatgtaaccatctgcataaatacactgcctgttcctaccgcggaaatacttgccgcgtctccaaacctcccgacgatcagcagatcgactgcgccatacgccgactgcagaaccaatgcgcccaaaacgggaactgcaaacttaataagcgcaattcccacagaaccttccgtaaatgaaatttcttttttccctttagcttccataattttaattctccaatcccggcatcgtttcttgcagtcttgtgatcgtctgtactgtctgctctacttgatctgttgaaatatcagcgaggttgtccgcccatttaccatgaaattccagaacatactttttcacatatgcctctcccttatcggtaagtttcagtaatatagtgcgcttatcctgtgacttgctgtgttttcgtatcagttttctttcttccaattcttttaccagcttagtaacacttggcaaagtaatgtttagtgtcctgcttatatcactcacacagcattcttcctgataaaccgccattttataaatcacgtgtaaaacgtggatatggcggggtttgatcccctttgggagcgcgggaagtgtttcgattattttcttggcaataaaacagcagtccaataatttttccagctcttttgcattcataagactccattccttctattatttaccgttaataattactattagtaataataaagtcatcggaatgctttgtcaaccttttaagcttattacagccaaaaacagtaaccgttcagatcatgaaggaatggccgccagacgaattaatatgccgctcccgcttcggagctcctcccagtagatgagcttttcggtgtcctcatccccccgcaacactaaagcttgtattctgcagccttgtccagcagctgatccagactctctgtataatccaggctctccttccaatcaggatcaagtttatccaggattaggcatttggccatgccggtccggtaatattttcctctgccgccttcaaaagcatccagggtatcgagataccgctcctggtattccttcccgctacgcagggatctcagtatatttccttctacataatatgccgttccctctgtcaattcacagcgctgctcagcgataagtgcttttgctgacatgttttcctgacgctgcctctgctgggttctatattgcactacggccgctttcagcttgtctgtctccttctcctgtgccgcagcttttaaaagctgcatctcctttatcatgcgcttcttctgctctttatcctgatccacctcttttataaacagagcatcttccgaactgcccgtttcattcccgctttgctccagctccttttccatctgggcaggggacaggttttctcccaggatccggaaatggctgagctgccaggcgtggaatgcttcatgccagattgtggcgatctgctcttctttgccatatccgctccccgataccatcccttccacgccgcctgccagggacagcaggctgtcaaacctctccagggtgggaataattacctcataatgatcccccaccggataagctgttcctgcaaaggtttcgagtaccggggaacgcttttctatgccgccctgataaaatacatagtctgcttttccatcatacatggcaaccggataatcctccagcctgaaattagaaaagcccagtttatctgcctgttcctgttcttccagtgctttgctgtaaatctgcttctcctggattccgattccccggtctgccgtaaaagtccagcctgccaacagtgctattccggctgcggctgcgatcaccttctgtacactgatccgttttttgcggatcctctttatgctgttcttctttgcacttggcttctctgtgctgtctttgtttatactaagcatctctgtacctgcctttttcatatttttcttcatctctacgcctcctttttgcggaacagatacagcagcatcccacatacgtagagaaccagaagaccgcccagtatgctgtggatctgaatacttttaccggaaagaaaccttcccgcctgtgactccactgcgtacagatccggtattagaaataggataccgcgcagtacctgccgtgccaggccggatacaattcccgacagagtttccaaaacgggatgcattgttcccgccagcatgaacgctgcggcaagcactcctgctgccattccgggcagaatcaggctgaccgcgcttgtaaacaggctcacggccgctgtgctgactgaaaagagcaaaaatgcagggatacattttgcaagaactgcatattcccctttgacccccgcaaataccatgactccagcatacaagataaataaagcgcacagagaactaatgatgcctgcaagggcaagctgcccgtgatatttccactggctgatgccgcggatccagaccagatggctggtctttctctcgtattcattcggtatcgtccgcaggctgagtgcaatggctattccgccgccgattacggagaccacattcagcaccaagggcatcatcataccgaattcagtcaccggcacgccgtttacggacaatgtcgccgctccgctcatgcacatcatcacgataaggattccgattataagcacaacatagatatcttttcttctcatccgctctcttaaagcatttttcatgattcccatctctctgctcctccgatcttctctacaaatatctcttccaggcttctcctgtctcttcccttttcccattcgtggagtaggcagccttttttcataataattcctctgtcgcacacacgctcaatgtcattgaggatatgggaattaatgataattgttttcccctcttcctttaaacattgaattgtatgcatcatctccactcgccccagtgcgtccaggccggcggagggctcatccagaatcagaaactccggatcccccagcagggcctgcgccagagccagccgctgcagcatccctttggaataatttttcacccttgtcttactctcttccagccccgcccgctcaagcagttcggggatctgtttcttcaactctgccttcggtatcttctgaaggcctccgtagaattccagcacctccctgccgttcaggaacggataaaaatacggcgtctccggggaatacccgatccggatttcctcctgtatttccacctttcctgcatcctttgggatcaagttcaaaatcatttttatggtggtcgtcttgcccgcgccgttgcttccgagcagggcaaagacttcgcccctgcggacagaaaaattcagattattgactgcgcactgcttttggtatattttcttcagattgctgcatgatagcatgttcatatgtgccctcccttgttaagatatgtctatcttacaacagcgccttaaagagaagataaatgcaacctaaagttaaccttaatattaacgggaacgtaaaataaaaggtgaaccagatttccgccgggccgtgtacttcccgtttgaaacctaatccaccttttattcagcctcaccgtatctctttcaccggtaccgccgtacgctttgtttttaaaaataatatgataaataccaatgttcccaccaggcatagaacattggaggccatgccccaagtcagcccgaatgtcccgcagatcagtcccataacccatggaaaaacagtatgccccatgctgatgctgacaaagaaaacaaccgagacagtactttggcagtccgcgcattccttgtaccctatggtcaaaattaacggaatggcggcccctgcgaacagtcctgccgccgcatagccaatcattgcaaaagccatcaccggtatcaatacgcctgccagatgaagtacaatagccagcgccagtcccactgtcagaatatgctcttccataaaccggattgtcagcctggcacaaaccagtcttcctatgacaaggcagacccagaacaatgaagaacccatacttgcagtaaacgtacccgcgtcatattgatactgcaggtacagcggcacccatgtgctgattccgccctgatgtccacaataaaagaacatggcaagcagtaaatatataataaccggcttttttaatattccaaagttcatacagttttgattttgtgcccagattgccgccgttctcaccggggctttccctttgaacaaaaaaagtaccagcaaggccacactcacagctccgatatagccataaatcatctgccaccgtggcaagaccgtcagaagctttgccgcaagaagcggcccggcaaaggatcccgcgccgaagcagccatgcagcagatttatatagaatcctttctgttcgtcatgatatgctgctatctccgtgtttactgtcaaatccaaaaatttagttgcaattccaataagaagcagcaagataagaaaaaacgtaagggtatctgcccagcttactgcgagcattcccagcgcaaataccgcgtatgtaatgaaaatccatgtcctgttttgaaagtatttcaatacgaaagcggatacaattacaccggctaaacagccagtattgtatagaactgtgaaaataccccctcccgagacatccattccaaaatcattcagaaaatctaccatgaacgtgcccagaatagatgttcctaccgcataggtaaaaaacaatccatatatcaaaatgaaatacgccgtatttttattcttcatttcggttcctccaatattactttcttaacagaatcttgacagttcagacaggtctgaactattacacagaatcctcaaaaggattttccagtttcttatagtctctgtgaaaatctatttgtttgttttcaaaataataatatcagaggtaaaattacgactctataataatatcactaacttttgtcaatatattacttatttactctgctgcataatatttcaagctgataggtatcgccaaatccattcagatagtgcatcggttcaattgacacattgcctgtctgcatcagatcctgataccatttttacatacacagaaatggacagcggtagcataagaatgcaggacaataccaggatcattctataaaaaacttattttaatttttttaatcatggacctgcagttccctccttcgctcatatacctatgatagcattatatttctgaatttgtatttttttaatattatttagatttcacaacacagcataaaaatagggaaccgttagtaacaccggtttgcttgtcgcacccgcacttacgattttcctaacctcaggaaaatcgtctgcaatcatatgaccactgttttcacagggaatcatcgctcgtctaattactttaatgcaagccgccgtatagaaatttctatacggcggttctgtttaacgtgttcatattatcattttttcttctctgagtcccggggaggataaagcaacaataatattccccttatccccttttctacgccgcatccgtatagaagccggttcctctgcagtatatatatgatatccccatacgcaagctgttctatcccattatttaccgtatagcccacctctcttaattgaccggacgcaaacggaatcttttaaaaaacaatgccatgatagttcttccgccggccgcctcccatcttttattatgtcgccggccttgttctaatttcccctttttatctatctttcatgaagccacgtataacgttcgtcttcacagcggtccgtctgaagccacggattcccatcaaaatgccggatcatccagcatgtatacatctggaatcccggagccgtcgcctgaggatgcagacatccccccggaatggctgcaaagctattatctacgctcttaaaaacctgatctcctacaaaactcgcgccaaaaccctctgggcggtcaaacttaaaaaaatagacctctggctgcggatgccgatgcggcagatatcctgaccagtttcccttattattcaatacttcacccagcaccatattggagaacggctcctcctcgtagtcgaagattgtatttacacgacgcaccgccacattcccaaattcatctttccccgaatataaccactttatatcctccgggctatacatccggttcagaaaattcttttcgttacgtgtacattggaccagtatttctgcttccgcaagggctgttattttcaccctctgccccttgcatacatgtaggcaccaaggaccatcacaaaatacatcttttcttgcggcttctacacattccgtttgccattcgtaaataacttttcctgacagcagaagaaacgcagcctcctcccactcccaaaagaatatcctgctctcttttgcggctatctgatagacccggatatccatctgcatttcactgtatgggccatcatatgtcgtaagcagcatctcttttgtttcatcaaatcgcgggtatccaaatacctctcccatatacttcacttccttctaatattcctttgccatcttccgatggcacagcatattttcatacgctttccgaaccgattctttttgtgatatctctgccactcccacattccaccaagattcatagccatctgtcatcgtcttgggaagaaccttgaggtcaaacagacaggctttctgttctgccctcgcctgtataagcgctgcttccaattctgttttcgtccggcaggtataggctttcaggccgtatccttccgcaatctttgcataatctaccggaatcaggtcaccagacggcatttttccctccgtgtatctgaactccgttgcaatactgccaacaccatgcaccatttccaaattattgatgcagccaaagccacagttgtcgaacacaaggatattcacctttttacgttcctggataatcgtcattatttcactgtgaagcatttgaaagctggagtccccaaccagacaatagacctgaaagtctggttctgccatcttcactcccagggcggcggccacttcatatcccatgcaggaatatccatactccgcatgatatcctccgcgcttatccgtcttccacatgcgctgcaagcagcttggcaatgaacctcctgccgttataatcgttgcatcctcctcgattgtttcctgtattgccgcaattgcttctgtctgtgtgagagttccgcccgtcagcctaacaaactccggaagcgtgcggagatctctctttgaaataattggctcaaacccttcgcctgtatactgtatttttccaagccattccagctcctgatcccaccattttcttgcctttctaatctcatccgtgtattttgattgatatccacagtctttcagtctcgtcgctaattgttcgattatcactcgggcatcaccaaccgcctttaccgcatccatcttatatgcatgataccgattattgttgactgtaacaatacggactccttctttttggtacaaaaacttggaactggtagtaaaatctgaaagcctggtaccgactgcaatcacaacatccgcttcccgtgaaatcacatttgatgcatatgtgcctgtcacgccaacgccgcctaggcaataggggtggctggatctgcacgcactttttccaccttgcgtctcgcaaaatggaatattaaattcctcgcagaacctctctacagcctcccccgcctctgaataacgcacacccccgccaacaattaccaccggttttgctgcctcttttatgacggatactatatcgtctatttcttcatctgctgcagccacgcgcgtaatcctgtgcacccgtttctcaaaaaaatattctggataatcgtacgcttccccttccacatcctgacaaagcgcaatacagcatgctccagtttccgccggatccgtcagcactctcattgcattaatcaatgcagtcatgagcatctccggtctaagaatcctgtcccaatatttacatacaggtttaaatgcatcattcgtcgttagtgccaggctattactctgttctaactgctgaagcactggatccggttgtctagacgcgaatgtgtctgccggaaacaccagaagaggaagattattgaccgtagctgtagcacaggctgtaatcatatttgctgctcccggtccgattgaggatgcacagggaataatttttctcctattattctgttttgcatatgcaatggcagcatggcacatcccctgttcattccgtccttgaagcacttttaggtcgccaggataacaatctaatgcctctcccagccccactgcaatcccatgcccgaaaattgtaaatatcccttctacgaacttggtctctttcccatccatcactacatattgattatccagaaacctcacaatcgcctgtgcaacagtcagtcttactgtttttctcattcttctccccttctctgctctctcacaatcatttctccatatctttcttttttatcccggataaacgtagccacctcttcggcatccggcagcgaatccgaacagttgttgcttctcaccatcatagaagcctctgctgaaccaaattccaggcacttcatcatatcccatccctgatagattccatataggaatcctgctgcatatccgtctccgcctccgaaccccttcctggcctctacgggaaatggttttacgaaaaagctctgtccaccgctggtatatgctgccgatccctgtattccatgttttatgacaacaatctttgcacggtatcccatccaaagtgccgcagacatacagtcatcgttatccacattcaaaaatcgctctgtcaggttaaattcttctctggaccccatcaggatatccgcttcctttgcggcaatcgaataatacactgcaatctcgtcactattcttccagttatattctctatagtcaatatcaaagataacccgagtgtcatgtttccttgcaagcatcaccgctttaagtgcagcctcccttgaagggctctctgaaagtgctgttcccgatatcaggattgcctttgcactttttatataatcctcatctatatcatctacttccagctgcaggtctgctgccatatttcggtacatcagaaggctactttctttcggagaaagcatttccgtaaatgtcagccctagcttttctccgtggccgcattttgaaatataagaggtatcaattcctttttccttgagatactctaccacatattcgccgaattgatcgtcagacacttttcctataaatcccgccttcaacccatgccttgaaacgcctactgcgatattcgcaggagagcctcctacaaatttctcaaaaacatgaactttttttagagaattgaacccctctttaactgagtcattgtaggcaggattgaaatcaatcgtcacacgccccaacaatatcagatccaatttccgatttctgtcaaaattgatatactccatctgtatcctccgctttagattgtaccatcccacgtactcacagtgccgaccttcttctcctcctcgtcaaaccaacgggtcgtcactacttttctctctgtaaagaaaaggtaaccatcttttccgagtgtatgaagatccccaaagaatgaatccttgtgtccgttaaatgggaacatgcctaccggaactggaatcccaacattgactccgaccattccgccgtgggtattccttgcaaattcccgggcatagtggccgttttgcgtgaaaatgacagaaccattggcaaagggattcccattcatcaatcttaatccctcttcaaaatcttttactctctttatgcagagtaccggaccaaagatttcctgattccccacctccatgtcctgcgtgacaaaatccagaattgttggtcctatataaaatccgtcctcgtatcccggcacagccacattccgcccatccagaatcattttcgcgccttcttgaagccctttttctatccagccaagcactctttccttatgttctctgttgataaccggtcctagtccggtctttggatcataggccggtcccacaacaagtcctcccgctttcttaacaatctcctccacaagcctgtttgcaatgctttcctgcactacaaccaccggaagcgccatacaccgttctcccgcacacccgaatgcagcattgacaatcccggccgccgtcctttcaattggtgcatcctctaatacaagcgcatggtttttggcttcgcacagtgcctgtacccgctttccatttgatgcagccactgtataaatatgttttcccacagacgtagatcctacaaacgtaattccttttatagccggatgctcaagaaagatttccgcctcattcctggaacatgtaacgatattaattacgccgtctggaagtccggcttctttgtatatctctgcaatcctcatgcatgtctgcggagtaaaggttgcagccttcaatacaatcgtattaccacatgcaacacagattggcgccatccaccccatcggaatcatagctggaaaattgaatgggacaatccctgcgaaaactcccagaggctctctgtatgacacagtatcaaatccactggaggcatccatcaggctttctcccatcatcagagatggagctgaaatcgcctgttccgttccttctattgcttttagcacatcgccttcagcctcagccagatttttcccattttccttagcaacagagagagtcagttcatccagatatttcactagcagctcccgtacattgtataagatctggactctcttttttaccggcgttgcagcccagcccgggaaggcctcctttgccgccaaaattgctgcttctacttcctcagctgtacagcatggaacctccgcaattacatcaccggtgcttggatcatatgcttttttataaatcttcgtcctggactcttttacagtcccgtttacaaagtatcccaatcttttaatctcacacatttttgtttctcctttcgcaatctccgcattttatctgctgatactctgtcccaaagcctcaatggatgtctccagaccagccatcacactcatcgttagatcctccatttccagagatacataaccgtcatatcccgtcattcgggccacagagaaaaattctctccaccattgcagatcttttccacacccgactgccacataattccacgaacgttgtgaagactccgtcacagcccttgtttccagcagcccgtttacatcgcacaagccgcgctccactctcgcgtccttaccatggatatggtatactgcaccctccagatttctgagtccggcaatcggatctgctcccatgacaattagatgtgacggatccatattcattccaatcatcggtcccactgcatcccgcaactgccacaatgttgccggattgtacacaagctgagatggaaattcctcaattgcaatcttttcaattccctgtttttcacagtgttctacaaacttcttccaccatggaattgccacatcttcccactggtaacgcacgcactctggcatataatctggccaagacacagtggatgtaatccaattcggagtcatatccgttggcgctcccgccggaagccccgacatcatcaccaatttttttactcctagcctgcctgccagcacagcagtctcatatgcccccgccgtatgcctttctcccatttcacccgggctgagctgattgcccgaacagttcaatgcagcgatttctattccctttttttcaaataaccttctgaattcttcaagccttttctcgtcatggagcagtttttctgccggagcatgggcgcagcttccccagccgcccgccgtcatctctacggcatgaatcccaagagactttactttatcaagcatatcctccacacttagactgctaaatacatctgtacagattgccagttccatagttacctcccatcatccaacagttctttttctatccgcattctagcttctggagcttgcacgtccattttttccggaaatccgaacatggaaacacatgcaatcgtatctccgccagcttttggcgcatctgtccgcatctgcctatatgcaaagtccatttccctcagggtctcgaagatcccgtcaaaatccacatccccttctcccattgcaagatgttgatgtatcgtcacatctttccgcccatgctggttaagccaaggcgggttggcaatgtagcggcagtccagagtctggttatatgtatccgcgaacagcacatgtgtcagctcattacctgcatatttcagcatagaacggacatccccttttccctcatcgtagaaaaagccatgaggcgctgaatatacatatcccaaattgggcaagcggaaggatttgaccaaatcgcaggcttcttgattctgttcgcagaaatcgtatggatgcgactgtatctctacgcgaatcccttccttctcaatcagcggaagcagctcttccattgaccgaaaccacatcccgttgcagatttcctgctggttcgggtctcccgacagctctgtattaattacctttacccccatatctgccgcaatctcaatcatccgcttccaattttttactgcaaatcttctttcatcctccgtagggcctgaccatcggtataccacaataaaggaagaaatctcaagaccggtttcacgcagggccttccggtattctcgctcacattcctctgaaaacagaggatgcttgtaaaatgggttaatccgtggatggggagactgctcaatatatttatacccccaatccgccacctgatgtaccatccagttaatatccaacgactgttttgccagtacatctacatcaaatgcaatcttcatagtccatctcctattctattccctataaaatttaggcctctcttctatttctatctccacagtttcttgtttgtcccttgctttagatgccgctcctgccgtaacctgtcccacatatccatcccacgctgtaggaccgtcaatccttccacgcctcactccatcaatccactcctgcaattctgtatcgtatgccgcttcaaatctttcggaccagtcgccgtgaactgcatatcctctttttccatctgcacacacccggatattcgctggttccggaaggtttaatatcccgtcctcacagcatatctcgcacttgatatcatagcaatgccctgtgttcacaaacgcttcaacgtcaatccttacccctgactttgtagtgaggatcatagtctgtggatcccttagccgctcatgtgcccgccgcgtattctttgaaaatacaacttccactgtagcgtaatcctcctccagaagccacctcagaacatcaatctcgtgtatcatagaattttctactgccatcttagtcgtataggattcatctaccgccggattcctatgtgcacaatgcaacagcagaggctccccatatattccactttttaccgcctcctttaactggcggtatcccatatcatatcgccgcatgaagcccacctggaccaggtgtcttttgcctttcatctccgcttccacaatacgccgacatgcctcaggctccggtgccagcggcttctcacaaaatacatacttattctgcttcacagcttccaacacatacttttcatgtgccatgtccgccgttgtaacaattactgcatcaatctcagccgatgcaatcaaggcttcaccactctcatataatttgcatccatattgttcagccaccgtctgtcctgctttcagattagcatctgtacacgcagtcacccagccgccgtgcagtttcttgttaatcctttccatatgagatcttccgattgctcccgttccgacgactccaattctgatattctcttttttcatgccatcaccctttcaaatgtctgcttttttggctgcaagcacctgataaatgcctccctttaccgtattacacatatatagctcttgttcctcattccagccgcctaccggcatccctttatgtgtgatttgtatctttttacccgtcataattaccaaattgctccccctaagagatttaacaaccgcttgcttcagtctgccgtcctcccactggatgtccacctcaaatccgccctctgcgcgtagcccctttaccgaccccttcttccagcgctcaggcaacgccggaagcagctttaggattccgccttggctctgtagtagcataaatgcgattgctgctgccgcacccagatttccgtctatctggaagacttccgtctcatttggcgtcagccccagcgggggatgcaggtcaaaaaaattcggcgccgtcaaatcggataacaatacataaagatattccaatgacttatccccttcccgaaggcttacatacaagttaatcagccatgcacagctccaacccgtatgtccgcctcccgcctctacccttcgctggattgacttccggcaagcttctacatatgcttggtctaacttttctattccgtagtctcctggaaacaagccatacaagtgagagaaatgccggtgcccctgttcagattcctcaaaatcctcattccactcctggagctgtccatattttcctaccttatagtccggcattttattcaatgccgcttctatccgtctggcaaataccggatccatgttcagcctttgttcaatctccagcaggttttcaaagagctctcgaaccagcgcctgatccattgccgatgaacagctcacggagcatacatcgccatctggaagccgaaatgcattttccggcgacgtggaaggacatgtctgaagcacgccttcatgttcaaccatccattccagacagaattgtccggcactcttcatgacgggatacgctctatgcatcagaaattccaaatcctgctcatatttataataggtatagagatggctacacagccatacgcctcccatcggccagaatccatgccgtgggttcacacataccggagtgctcatcctccagagatctgtattatgatttgccgtccacccagaacaccggaatgtcttttctgcagtcaccatgccagatatgctcaattcttcaatcattttaaataatccggcggcgcattcattcaggttacatatccctgtcatccagtaattcatctgcgtattaatgtttatcgtataattacagctaaaatctggcctgacagactcattccagattccctgaagattcgccggttccgaatttcccagagatgacgcaatcattaaatatctcccatactgaaaataaacttccaatagtttatcgtctctgcctcccagcctgatgcgctccagtcttttatccaacggcagttcagaataatctgccccctctagctctagcttgacccgtcgaaacagtttcgcccatgcttctgcatgttctttttgcaggtttttggccaagtttcccgacacctttcggatttgctctttacatcgcttattcaaaagcttaaaatcctcaaccctctcttcccgaaaacctttatatcctgattccatgcatacgtacactgtcagttcgtttatattttcagctgtgatttcgccttttttcagaagaaccttcccttcatctgatattgctttaattccaacgctcagacagattcctttccgatcctcaaaatactggattggatcgttatgctcgacataattaggcaccacatgccctggcgcttcattctggagaaacaaaatctcttccggtttgtcttccgtaatctgatgcttcagctctgattccagccaaatccgtatgccctccagttttgtatcactttttatatgtaagatgaccgccttttgaggtatggatgcatatgtctcataagatattcctttgtctccaattcggaattccattactgcccgtccacgctccatgtcaagataacgacgataacccgaaatttcgccatcatcttcaaaccgaaaccttaaatttcctaccggcatataggattccgtataggtcaaagtcatattctcccggatcagctgttctgcttcccgaaatctgccgccaaaaattttttgtcttattttataaatcatttggtccgaaacttccagttcctttttttctcccgttcccgaccaaaatgtatccagattcaaagatatcttctcttcccgggctcctccatagaccatcgcacccatactgccatttccaaccggcagcgcctctacaaattttccggcaggtttctcaaaccatatctcatttttcatcttgcattacccctttactgcccctgacaacatccctgcctcaaccctattgtggaacaggatataaataataactgtcgggattatcgccatgattataaatgcaaactgtggtccatattccgcggaatgctctcccacaaagctcaagattcctctcgaaaccgtatactttgactgatcagtaataagtaccagtgaaaagatcagttcactgtacgcatatacaaagacaaacactgcctctgtcatgataatcggcttactgaccggtaccagaaccttccacagcaaccgaaaatcaccgcatccgtcaataatggctgcctcatccaattccctgtcgattccatctaaatatcccgcatatagatagattgcctgagggaggttaaatgtaatgtagattaggaaaaggaatatatatgagttctttgcatttaatgttactgcaatattagagattggaaccatcgtacagtgcaccggaatcataattcccagcacaaaaagaaggttcacatatttcagccacttaagccttttcctcgaaatcacatacgctgccatcattcctacaatcgttaccgcaaacgttgtcgccagccccagaatcagcgaattagtaatcgatgtagcagcatgtgcaatgtcattggccttgatatagttttcccacctccaaatctggggaaggctaaacagcccaagactaatctcgctattatttttcaaagacgagaaaaatgtaatgataagcggcaaaaccgttataatcatccaaaaaacagcaaaaccataacagataatacttgttactctttttttcatgccctgctctctccttataattcttcctgcttcaaagctctatttaccacaaggctcagcacgattcccagcacaatcatgattactcctgtcgcgctgctcttgccatacagcttgtactggaacgcttcataataaaggaggattcccggagactcgctgactccgttaggcccgcctcttgtcattgcccagatgatgtcgaataccttaatgcagcccgtaatacagataatagaaaaaaccttaaatgaatttttacaaagtggaatcgtcacataccagattttctttaacccagagcaaccatcaatctccgctgcttcataaagcgaggatggaatagcaacaatgcctgacgcaaaaatcagcatattatagcccgcatacatccattcgtttacgagaacaacacaccagatatttactgtaggagtcgcaagccagtcctgcacccattcttcaagtcccagccacgacagaatctgtgcaaatactccccagctcgggttcagcatatatacccacataagcgctactgcagtaacccccagcattaccggcataaaatatgccgtcttcataatcttagtgaacttcatcttggacgttataatcagtgccaagataaacgagagcggcatcaggattataaaaccgcctacaagaaaatacatacaattcttcagtgaatcccagaacccctggtttgtcagtacgttctcgtaattttttagtccgacaaacaactttggtacattcgcaattcctttccatgaatagaaggataggtatatggtctgtatcgtcggatatacaataaacactgccagtaatatgattgccggcattaaaaacagaaccggaacagctaactttctttttttcctcatttttatgccctctgatgcgaactgcccgcatcaacgggcagttcctgaatgattattcgtattccgctatcgtatctgcaatctgctttccaacttcttccggtgaatttcccattgccagcccttgcagcgccgctctgacagttgtaatcatatggctggctgtatcataattttgaaggtcagatttacaagcttcggtctcacttaaaatcgtattaatgtcattcagcagataattatccacctcgtaattactcttgattgccattgtattggcgttagcctccaacagaccgtcaacatactcttccgaagtcaaatacttcaggaatacgacagaagcagcgatttcttcatctgtagctcctaacgttgaaataaagaaagcatctgccgcacctcccatatccacatttgcatattcttgtgttattgccggaaatcttgcaacacccattttcccttccttaaatatgtcactgtccgcagccgttcctgcaaaccagctcccatcataatggaatgccgcttcgcctgctttgaactttgcatcctcctgatccatgtccatgttcagcaggttatcgcctagatatcccttgtccaccatctctttaatcatggaatagatctctatctgttctttactgtcataagccatctcgcgtttggcaagctgttctgcaacatccggtccatactttttaagggagagaactgtatgcagatgcccaaatctaaaatcagacttttctcctacctgaaacggcgcaattccattactcttcaatgtttcgcatgcatccatcagctcatcaaacgtggtggggacttctaatttattcgcctccagaatctctttgttatagtagagaaccacctgataacagctccacggcactgcataaataccatcgtatccgtaacttgaatatgtgcccggctcccagtaatccaaaaatctatctcgccactgtggatcagcttctagataaggctccaaatcaagaatagctcctgcagctacatagtccagatctctcgatccaccaaaatcataaaatacattcggcgcatctccggccgcaaagtctgtactgagtttatcaatatagtcctgttccgttgtgatgttggtcatctcaaccgtaatgccattatccatttcattgaacttcttcaccatggactcatagtacgctgaatttgcatcctccgcaccacctcccattttagtcgctacccgaatagtcacatcctcaaatgtcatatcatctacgttgtacttatccgtatccgatactttactctgagcagaatccccactttttgccccctcttttcctgcacatcctgtcatcgtaagaagcagactaagactgacagctacacttagaaaccttttcataaatctttctcctttcgtttaaaaatatttatgttttatgtattttattatacataaaacgaaacgtttttcaatatattttattatattttgttatattttattcttttcgtcattttttatatatttattagtattcatttgtgcatatttacttttttaataattttacttgttttttaatcgcgaaacgtttcattcataataacaccttgcaaatgcctataaatacagatataatgaagatagttttaattctttccgtctttatccggcagaaatgaaaggaatgtataaatgaaagctacattaaaagatatcgccaaagacactggtctgtctttggccacgatatcaaaatacatcaataacaagccagtatctccccgcaaccgtgaaaagatcgaggaatccatcgctaaatttggctacaccgtcaacactgctgcccgcagtctgcgcacccgcagaacacggacaatcggaatcatctctcctgcaattgggcatccctactggggaagtgttatttcttatgttgaacagtttttatgggaacacgaatattccactattatttgcactcataatgtaaacagtattaacgagcagcagagcgtacagtttctgattgacaagcgggtagatggaattctttatatcgcctattctcaggatgattcttctataaaattgatacaggaacagaacatccctattgtattccttgataataagcccgatactgtaactgctgattttgtaacctcccaaaacaaaaacggtgttttcggggctgttgagtatttgatccagcacaatcaccagcgtattgccctgattaccacaaactcgctgtacacgaccgccgaaaggcttttcggctacaaacaggctttaaagcattatagcatcccggtcaaggataactatattatatacaatacgcccaattctaacctcgaaaacactcagctaccggggctactggcttcttcacttccccctactgcgattatagcctctacatacgatacgggcgtcgatatcattacttatgcacacagacatgggcttacaattcctgatgacatttcgttaatcatctttgacgacaataatatcttcaaagctcttaatatcactgtggtgcggcaggatttctttcatttagtccagaactctgtccgtcttttgatagaacgaatcaatgaaaatacagagctgcctgtccagcatattcaagttgacactgacctagtcgtccgcggctctgtaaaatttgttaaatagaggtataatgatgtctataacaatcaaggatatttcaagagaaacgaacttggccgtgtctaccatttcaaagtatataaatggcggcaatgtccgcacaaagaatgcgaaggcaatcgaagctgcaatcgccaagctcggttaccgcccgaacatcatggcccagagcctgaggaattcacgctcatataccgttgggatcattgtcccgactatgaatgatccattttgctctaagctggtcgaacagattgagcagatgcttcaactcgagggttactcctgtgcactctgttgctatcattcaaaaactgctatccgggaaaatactatcgaatttcttctccagaaaaatgtagatgcgatattatttttggcagattatcagattcagagcaaagaattatatataccagacaccagagtgccgctgattatcctaaaccgttaccttgagggaatccctgcagattttatccttccggatattgcaggagggatctacacatgtacagaatatctgattaaacatcagcataaaaaaatcgccttaatgaccgcatgccggcagaacgattccgaagacaatataggataccggcgcgcccatgaagattatcatctgacataccatgaagattacaccgtccattccacagacaggtttttagctctgttaaacagcgacacgcccccggattcactgataatatcagattatcagctctataccgacgctgtgtccacctttttttctatgggattagaaatcccagatgagttctccctgattgcttgtgataattctgatttcggtcagatcatgatgccgccgattacagtgcttgattatccaattaaagagattgtaaataagaccatccgcatcctttctcaacggctgaatggcgacttttcagcctttccatgcctgttccgtttgaagacacagcttcacgtacgagactctgtgctggattgccggtaatcataatatggaaaaagaagattatgagcccctctttccaaagctcataatcttctttataaaataggattccaaagatcctctcagccattcagataagatacggaatgagtttcacaccatagataacattacagacggggatatttatattaactgcgcagagtcctatctgatcaaatatctggctacagccgtaaaaaggctaaacgggcgctatcccgggattcattatcacatcaccagcggcgatacatcgattgtagctgaacatcttgaccggggactgattgacatggcttttattgccaagccgcatgacctctcagaatatgtttatctgggaataccggaaagtgatacctggggtgtccttatttatgtacagggactgtccgctggagcaaaattcagaaatctcactggacgatttgatcccgtattccatcttctgctcggaacaatccataaaggcagacctgtgggaaaaaagtgaccagcttcagatcacggccatctttagccgctccaataatgttgtcgtttttgtccgggaagggccgagcattaccattacttccgaaaggctgattgaaacacactggaatgaaaacgcttaccttcctttagatctgcacccttgcagaagtttttaaattcttcatttgtttttttccatcccgctcctccggatatagcaaaaggaacgattacctttcactgcagattataagattccagaaatgtgttaataatggttagcgctacatacaccaataggggacatcaaataggggacacctctgttatatctttttatcttttaatagttgcacatattctatatcatcagacccccctctattttttagaaacaacttttttctgctgtaaacaagcagctatcctatcaacaaatcctccatctatattagaaaaatatccgctaatttttttctctattgtttccgtaaaataagtacatcttaatagatagaatttcataatctttttccttcatttcttcgtttatgaaacgtttcctcctcatggatgtctgcccgatcatctgtaaaagctggatcattaaaatgccacttttttctattccgcttctatagttaagataaagataactcagccggccgaaaatgcagaaagccccccgggcgtatacgcagcccaggagattgaagacgccaagcagattgtccgtgaccaatttacagaaatgttcaccggctgtaccctgaccggcctgtggtatgacggagaaatcagccgcaaacaggccgatgaatgggccgaacagtatgaagccaaagaagcgctcgtcctgctgtctaatttcgatgtagacgcttccggaggagacggaagcctgaatcccaattccacctacactgactggaactggattctcgtccgcaattccgatagcgaagcatggaccctaaagacatggggctattgataagcatagatcctcttaatatctcccctgcagctctgagtcccatgggagcaggataaatatcacaaaatactgggaagttttcccggctgctgcgggagcccggcgccggtccgggcgctctttgccagcttgtccgttcatgtgcaggcctattctctgagaggtatatttctccgcattttgcaatatagtatattaattttattttttcgagggcgccatgcagacagttttccaaaaaacattggaaagtacaatgtactaccacaatatccctgtttttatctacaagatccgttatcccttttttacaaccacatgcagctcagctgccgccaggaagatcaaccaatactatatctgccattcccgggcggcagaaaattactgccaaacagttcttttcccccaggccgttgagagtgcccggtacattcaagatgatcatattccctttaattcttatgagatggatacccagttcaaaattacactgaatcatgattctatcgccagcctttataacgaccagtatacctacatgggcggggcccacggcatgacccgccggaactcagatacatgggacttttctaccggttaccgcatctgccttcggacgatatattccggaaattcttcttatccggagaacatattggaagaaattgagaggcagaccgcagagcgtttggcggcctccccctcttcttattttgataattatccggctcttatacgggagcattttaatcctcaaagttattttcttgaaccgcgcagtattgtcatatactatcagcagtatgacattgccccctatgccacgggaatccccgaattcaggcttccttacccggaaaatattacctcttgtatatagaacatatgttctgatacaatcattttaaaggaggtagtacccatgaagactgttatctaccacattgatgtgaacagtgcgtttctctcctgggaagccgcataccgtcttcatcatctgggcggcaccctggatctgcgcaccattccttccgcggtctccggggatatggcggcaaggcacggcattattcttgccaaaagtactcctgcaaaacgcttcggcatccataccgggcagacggtcctggaggcccgtcagaaatgtcccgccctttatatggttccccccaattatgggctttaccagaaatgttccgatgcctttatcaaggtcctgaatgaatatacgcccacggtggaacagtacagtattgacgaggcctttatggatatgagcagcaccctgcacctctttggaagtcctgccggaaccgccatgaggatcagggaccgcatccgtgaagaacttggctttaccgtaaatatagggatttccagcaataaactgctggcaaagatggccagcggatttcgcaagcctgaccgggtccacacccttttcccggaggaaatccaagagaaaatgtggcctctgcccgtctcggatttattttttgtgggcagggccacggcctccaagctcctgaagcttggtatccgaacgattggcgagcttgcggcaagcgatcccgagcttctctcctctcatctgaaaaaacacggcaaggttatctgggcttttgccaatggaattgatttttcctctgtggagcctgaaccgccgccgcagaaggggttcggcaattctaccaccattgcctttgatgtgacggatgctgggatcgcccacctggtacttctggggcttgccgaaacggtgggttccaggctcagggagaatcaggtgcaggcagaactgatgtctgtaggaatcaaaagctttgatctgagttatgccagccatcagatgattctggataaccccactaacattaccacggagctgtaccggtctgcgtgccgcctgtttgaccagctctgggatggcagaacagcaatccgtcatctgggcatccatacaggcaggctgcaggatggaacggcccttcggcaaatgagcctttttgatacagcggactacgcaaagctggaagcatgggacagcactatcgattccatccggaagagatatggcatggatgcggtccggcgggccgcctttctggatacgccgatcgaccatctggagggaggcatttcccgggaaaagcgagatgtagactattccctcctctgcatcgaataattttactccggcagatagttttattttttaatacaggagatttgttaagagatgaaaaagctgatgtgtatcttacgctataagacaggaggtatataagttatgggtatgggaatcggaattaatgttcatacaccggatgccggaaagatccggggacgccaggaaccagtggcctgcggtgtctggtatacaagcaccggaaccgctatcccaaaactgatcaaattccagggggaggacggcgagatccgcacactgacaaatctgcatgtactttcctttgaaaaaaagaattactgcggcattcccaccgtagaatacgaatgtgatgcagtggtcgatgcccgccgctatctcttccatctgctctactatgtagagcatcagaaatggacggtgctctggaagtcctcccagagcatataacccgccgaaaccttttttactgtttcagttttccacctgataaatgcgtgcaaactctctcacatgccgctcaagaaccataagcgcttcctcttcttgctccggctcctggtcgtatttattaaggaggaaaaaaatgggggaataaaagtgaagagccatcacttccggatctgcctctctgaagattctcctcctgcacatttcttcaaacagggcgctctgataggagatgctggcttccataaagatctggcggtatactttatatatgtctttgctgcggtactgctctatcgtcagcatccttctgaacctggcagcgaattcgtccttcagataaaacagaaagatgcccctgctaagtgccagcaatgcctcaagcgagagaccgccatacaatgcggcggcctctcccatatccgattcacccggaaggccgaaatccagagagatccgttccatcctaagggacatctcctgtacaatcgtatcaaaaatctcctgtttgcttttataatgtttatacagagaactgtctttgatccccactgcatccgcaatattcttcacactggttccctgatatcccttttccgcaaagagcgtcaacgcttcctctataatccgttctttcgttgtcatacgtgtctcctctaaatgtgcatgatttattcgcattgcagcagcgcctgtacttcacgctcccgtccaaacagtacacagccgccgctgtgctctgcatccagcagcccaccggcctgaagcctcgcaaacagaggggaacgcagcacttcccgcagacttttcccccggatatttgtatctgaatatggggaaaacgggcacggttctgcccctccgtccgcgttgatgtggaaaaatcccctgcccgccgccagacagccgcccgatgatttctcgtctcccgggaaggatatgtacagcatggacgtattccggcttcgaagttctgcaagccttttatccataaatgcccggtctgtatcatccggcgccagttcctgcgtcttcccgtcagcgggaacatattctacataaatcacggctttacacccggccttatcgagttcttctgtgaaatcgcaggaagtcacttctgctatattttcttttgtcacagtaatagatgtgccaaacagaattcccgcttttttcatccgttccatggaatctgacaatattttataaacgccgtctccacgcctcgcatctgttcttccccgctctccttcaatactgaaaaccggcaccaggttcctgtgatcggaaaataactgttcataggacgcatccagcatagtcccgtttgtaaacacagggaataaaatccgtttatgtactgccgcctcttccaggacatcccgccttaataacggttcccctcctgccagcagaataaagccgattccggtctcctcggcctgtgaaaaaaggctgccccactcttcccgggccatctgcctctttgtaatctcttcctcacacagatggtttgcccgtgcataacagcctttgcagtggagattgcacagactggtaatacttgctattaaaaacggaggaatatgttcccctcccgcttccgctttttggcgcagtttccgcgctgccctcgaagccgctgcatactgtaccataaacgcactttccttcggattgtccagggaagctttcagtatcccctttataatattttctacaccaccgcttaaatattcttctaattcaaatgtctgcatcctttccctcttttctttctgcaaatatcaacctgctctgcacagtaaacggacaggctaataaccactcgctttacattctcagtatagctagcggttattagcctgtcaagagcagataagaatctttctttatttgcaacaatttggttactgttcgctcccccaacctatcagcgtagtgatgggctggagcaacaacgtaaaacaaccgatgagcctgccctcgctgaaggcagctttaaatgagcaggcggtgttactgtttacaggcttgcctgtgaacagtaacacaattaattctttttctgtatcatactctcaaacttcttttccgacaatatctcgtttgttacaaattcaccatcatagaaaagactgaaagaggtaaagggcgccggtgcactttgagcctgttctgctgtttcgatttttaccgagtgccacggcacctgatttttgagtgctgccgcctccagaatcggaatatattttgccgtaaacggacattggtttgtatagtatgctacatatcctttctcgtccacatgcggcttttttgcatgtttcataaatgccggtttgtccacattttcagtaaatggcagatacatcagctcataaaagggttctgccgtgtccacagtttcgaatcccttatacttcaaatatcctggatccatcagaaatggccgtttctttgcggaagacagtacaacaagccctttcttccccttttctcggctgtcccgaatacactcttccagcagctgactggaatatccctgtcccttaaacttaccggatacccagaagcagtcaatatacatatatcccggcgctttgaccggcacccaggccgactccgcgggaatatattctataaagcatttcccccgcacatcccccttcaaaaataccaggccttcgtccagcctgtcccccagccatgccttcttggaggcaacctggcagtccttattgttggaaattgcacagcagatatgttccttctccagattttcctttgtcaatgcaatcaatttcatatatgtttttcctcttttctccgccacataacctgcgcaacgattattttctatatttaggttaacatataaaacatgacatctgtatgtcatatataacccctgcgaggtaaaatgatgatccggccaccccatcaccttaagcgcatcattagaatctaaatcgagcagtgcctgtgatatttcaatcaaatttcttccaagatcaagtcttccatatattccttcgcttcattctcattctccattattgcatccatatccccaaatctcataagcactataggcatggtcaaaatgataccccagcttttctgccaatgcggcagaccctttattctgagcatcccagctgggataccagtcccgttccaggcattctaaaatcagctttgcaccggcagcataagcgagaccttgtctgcgatattcttcctttgtatcaatctctatttcgattccgcctatatagcctgcataagaagatgcaccggaaacaatctcatcttctttcaaaatcaccactcccaaaccatggtcccgatactctggatattccttatattgagataccagatcccggctccattcgaaaagactgcactgcctgaaaatggattcatctatcatctctatacgataatccgccggcagcccggcaactgctgcttctaatgccgctttgttgaagacctctttttcctttttaaaggcatagcgcacaacctttttcgccttttccccgtaatacttttcaatcaccccgctccactgatcagtctgcggaatcataatcataaactcttgtttgcagcaatcgggcttatatgcggctaattcttcatctggttttcccgccagaaagcaaaagtctcctaacatagccatggcagagttgggcgcgtctgtattatccacatatatgtgccccatcacattctgcaggcatgaccaaataagcgtctcatcccagcctgcaaagagcggttctgctttgtgacgctgctgcaacatatatgccttattctgccgctctgctgcaaacctgcccgcagagcatgcactgaggggtgcccctgtggatacttttttactggcattacgcaaataatcatctgcttcttttcttgatttaaaaataatgatctctttttccttccgatatttattcagcagttcatatatctgcggcaattgtttatccggaaaatcaataatccattgtttaagttcttcatcaaattccgattcgacccatggcatatcttcgcgtttttttcctatccgggattctgcacctgaaaggcaggtttccagcggataatccattagaaaaacagtgtcgcatgctttcagacgttctgcaagtgttctctgataattaccgtcaataatccagctgtctttttttataatatcattcgacagcgtatcaaactcttctcttgtgatatttgtttgatccggcttatgccacagcatatccaggtaatatagcggtaatccggtcaaatttctaagtctccgggcaaatgtactttttcctgcaccaggacttccaataacgattgcttttaacataatattgtccttaataattgtttttttcttctaaaggttaattatagtgaaacaaacgtgacatgctcccaccacttaatcatagatttgaagtgggggcttctttctcaatcgccctaaatgggttccatagtttttcgcgaatctgtggatattccttcttcagtagtctactactggcactcttataagcattgataaatttgctgatttcactcctaggctctgcacggaatatcacataaacatgatctatgtcatgattccattcttccaacgtaattccatacttaggcgcaatatattcaaatatatccctggcccgatccgatatataatcatggatcacttttctccgagattttactaccataatcagatggtaacagagcaaatatgctgaatgtgcattacggtctaattccgttacattcaccactccttcaatttatcgactggttacattatatcatgcttgccataacagaacgagtgttcgtccatagtttagaaaagaattttatcaaagaatttgatattagatttcagaaaaaatcttctgtaccagatatggtatatagctattttcgccgataggctaattgcaattcatcctccacctaaagaggaaggggaattcttgcctataacatgttaaaaatagcatgtaatattttttactgtggcgtctcatttaacttacgacaaaagaatagatgcagaggatatatcaagaagattttaaaccatacttagtacatcgaaaatttatctcagcttaaaagcaaattaattattattcgaggtacttggatggtgactatggcttttcccggtgggttagctggtaatcttatttttttcgatccacaccgcatacgcaagtggtgactagaggaccccaatctgactttaatctacatgattatttcaatccgcaccgcatacgcaagcggtgaccgcaaaaatcatatggtcgtacaaaaatgttggaatttcgatccacaccgcatacgcaagcggtgacttctgaaactgctgacagcgatatcattgatacgatttcgatccacaccgcatacgcaagcggtgacgatccagtggttgtaaaaataattctcacaagcgatttcgatccacaccgcatacgcaagcggtgacacaacgcaatggttttcggaactgttaacatggatatttcgatccacaccgcatacgcaagcggtgacgctaaacagtaaaactggaaagatgtcaaaactatttcgatccacaccgcatacgcaagcggtgacgttgctactatgttacgttgtgggggtaaatcgtaatttcgatccacaccgcatacgcaagcggtgacggtttatgatttttgacaattactacaatatgacaatttcgatccacaccgcatacgcaagcggtgacattgattatgtcgcggtggtggaagtttacaatatttcgatccacaccgcatacgcaagcggtgacacgttccgacagaggttgattttgagctggatggatttcgatccacaccgcatacgcaagcggtgacggaaaagtgaaaaacaaattcgaaaccatgaaaaatttcgatccacaccgcatacgcaagcggtgaccctttgctaatacagggtatttccaagaatacggatttcgatccacaccgcatacgcaagcggtgacccgtaagggtttaaataaataaaaaagaaaaggaatttcgatccacaccgcatacgcaagcggtgactcaaatgacgggattgggttaaaagaatttaaaatttcgatccacaccgcatacgcaagcggtgacggttaccaatttatcgcaacgaaaaaatccaaggaatttcgatccacaccgcatacgcaagcggtgacagcaaaactaaataaatttgctttacttcaagatcataataatatacatttaccacaaaatcaattgattcatctcattaaatttgtattttttccatctgtatccccttccgctccttatttttaaggtgcgaatctcccgggaaattcctgtccgctactgattcgcactttattattttaacacttactgcatttctacaacgccataccccaatgctgttttagcccctaatccatatatttccaccatgcattttacagcttcatctatccttgtttttcctgcttcttcaaacagctgctacaccatatctactatatcaataagtacggcaaacttccatgtaaaaaactgaaaacttctaacaatacttcaataccttatcacggcgtttgcatcccccgctaatttttatgatattggaaatttcaaaagaggtttctataccataaaaccacatgacatttgtcatgaatatattttattcccatatatacattgacaggcgaggtatgctatggttaaatgtaagtacagaaaaggaggtatgaatatatgtcaatagcatccgatttgattcgcggacatacggacacaatcattctggcccatttgaccgaagaagacagttatggatataagatcaataaagacattcagataaagacagacaatcagtatgagctcaaagaagccaccctgtatacggcatttcgtcggctggaaagcgcgggatatatctgttcttactggggggacgagaacacaggcgcccgaaggcgttactattccatcacgccggagggggatctggcttaccagcggatgaaagcggagtgggaggaagccaaagggctcattgatattttaatcaggagtggtgagaagaaggaggatacacatggaaaataaattaagggcatatatggatcatctgttccgggatgtcaaaccgaccaggaagtccgtagagttaaaggaagagattctgcagaatctggtcgataaataccacgacatgatcgcagaaggcagaacccccgaggcggcatacaacatagcggttgcaagcatcggcgatatggatgagctcctggcagggcttcacggcgcgccatcctccgaaggcctgcctataacgaaagaagcgctggataagggacgcaggaagtcggcagtcctgatttctgttgcagtgatgatgtacattatgagcgttctccctcctatcctgctctccgatactattttcgagaacaaactagcaccggctctcatgtttattatgattgctgtcgcaacggcacttcttatttacaacaacctgaccaaaccgcgctaccagagaaccgatgactcaatcgtggaagagttcaaggaatggcaggagcagacggattccagccgcagggcaatgagagcgctcagcagcgcactttgggctgtcattgtggtcatttatatcgtagtcagcttctggacaatggcatggcatatcacttgggtcatattcctgatcggtgttgcagtggaaggaatcctaaaggctatatttgaactaaaaaaataggaggcaatcatgaatagaaggcaatcggcagtcatcaggatcatagcctggacaatcgcggctgtggcactgattgtaatacttattctaggtctgttcggaaagatcaacgtcatttccattggaatcaacaacggttactactatgctgattcaggaaaatataaaacaggaagtgcccagatcgacggaaatgaaataaaagacctggaactcaactggcttgacgggcggatccatgtggcggcatacgacggcgagaccgtacagttttatgaaaaagcattacaggacctgagcgaaaaacaacagcttcaatattatgttaaaaacggcaaactgatcattcaatatcagaaggcacagaaaagggtcttttttaacaactccactcttcataaggaactttttgttaaaattccggagaaaacagcagaatccatgggctcgttccggattgatacgatctccgcagatgcagaaataagcggaataacggcaagccagttccgcttggattccacgtccggtgattttgatctgaccggctgcaaaaccgatgggctctccatggacagtaccagtggaagtctgaccggaaacacactgtatgtggacggcaaactggagacgaatacaaccagcggcgatgtacaagtagaaggaagcttccaaaatattgattccgatactgtatccgggctcatctccgtaacctcaaaagtctgcccgaataagataagaaccgacagtgtcagtggcaatgcatcctttaccataccggagaacgacggattcacttacaaactggacaccgtcagcggttattttaactgcgacttcgagatgacacataaagaaggacggggtacctataagggtggaggagcttccttccgctttgagagtgtcagcggaggggctgaagtgaagagactgtaatggacttaaaaaaacctcaaaggggtcagacccctttcactaagcaggacacaggagcagtataactcatacatgttatactgctccttttaactttataaagatgtttcacgacacgcatttataaaacaactgcttcttatcagcatctcctaacatactgccgctcatgactcccctgccataaccggcagactccgcagcacgggatctgtaatatgttccataatctgttccgcatgaaactgcataaaactgtcgccggcccgggaccacccccggcggataacttccttactaatctgaatacacacccgctcaatcagcagagccttttttacactctcattcacatccgacaaaagtatcagcttcttcagttcttcagcgcaccccttcggttcggataattcctctgctccacggaatacccacttataaaagggcatatacctcccattcaaaagatacaacgctccaagcgccgccgttacaaacctgctgcacgtcagggctgccgccgcaaaatccctgcgctggatacacctggcgtaattgtactgtcccgcctgccccattgccgcacacttaccagcaagcttcttttttaatacatcttccggaaagaatccagccaatatattacggatcttagtaaattctccaagaggatcacagaacacctccccgttcaccgacatagcaaaataatgttccggtaccctcagccactccaggttatgatccggagcccttggatacccgatcagactgctgtagaactcttcgattgagtgtacgcccacccgttttcttcgttccggggtatagaaagaatctgtacagccgccattacatcccggcagggcatcatacgccagttgaagcgccccgccgatctcatcataatacttctgtggaagccagagacaaaagccgggcccccagtcatgatcccgtgaaatctcatcatcaaatccaagacattctgacccctggcccgccagccccgcggcaatcacctgggtatagtcactgaactccttttgaagcatcggcaaaccgcaggctgtgaagtatctctttgaaatctccagcccgttcatatctgttccccctcttctgctttaaagtattcctttaatgtcacttccgttcacgtctattcagagccccgcagattctcgaaagcccctcagcaagcagggcccttgggcaggccacattgaggcggatgtacgtgtctgaattctggacaaacatattgcctccctccagcagtactcccgcattttccgcaaagaacaatggcaggttcataccgtcttccacatatgccccaatatctacccatccaagataggttgcctcaggaatgcgaaatacggctttcggcagatgcttctccagataatcccgcacaaattcgaaattcgcatccagatactgcctcagttccatcatccagtcgtatccgccttcataagctgcctgcgcacccgccagcgaaagcgggttgagatcaaagttatgccgtgccagccaaagtttgcgtacatcctcattcggaatgataatattggaaaactgcagtccggcggtattaaatgtcttactcggggccatgcaggtgataattctgtcactattgggatacagcttagcaaggggaatgtgtgaaagcccgctgcggataaggtcacagtggatttcatccgagataattaacaatccattctccaggcagatatctgcgaatgtacgcagttccttctctgtccagatgcgcccggaaggattgtgcggactgcagaatatgcataatttcacatccgggtctgccgccttattcctgatatcctcaaaatccatttcataatagccgtcccctttccggttcaacaggtctgaacagacatattccacattgttatattctgcggcatacttgaagtatgcataggacggagtcagaatcagtaccttatcgcccggctcacatatatagccggtcagttcatataacgcagggataactccatgggatatgtagagatctgactgaggaaatgtccagccatatagttttctggtccatgcctgaaatgcctgaaaatacgcatccccgaaaagtctggtatatccgaaaatcttccggtcaagtcttttttgtatcccatcgataatgcagtccggtgtggcaaactccatgtccgcaatccacatgcggataaactcctcatccgcataggggaatttcatgttttcgtccgcatgaaaaatgtactgtctgaacccgtccgtattcatgcagcttgtatggcgtcggtcaataatttcatcaaagttgtacttcatgtctttttctccttacttgatgcagttgtccatatatagggcggtctgtaaaccatgagataatgtgtaacagttcacgcccgcctgaactgttaagattattcaatataggcaattgcctcaatctccaccagtgcatccttgggcagccttgccacttctaccgcactgcgtgagggatacgcgcctgttgtgaagaatttctcgtatacacggttcatggcggcaaaatggttcatgtcgctaaggaatactgttgtctttacaacgtgatccatcgtacctcctttggcctcaagaatggaacggatattggtcagtgatttctccgtctgttcttctacgctttccggaaaagcaccagtccccatatcaaccggaagctgccccgataaaaagagcagtttcccgatctgatttccctgagaataaggtccaatagccgctggggctgatgaagttgatataatttctcgcataagctctctccttaacttaaaatataatatgctctttcgagcagccgatcccgtgccctggcagtgtgtctgaaaattgattgctgcaagaccgggtatcaaaagtcttgggaagacaggtactcttctatattctgtaataccttcttcctaagcaggacgcctgacagaacagactgccccgctatgacatccggacagatcacattcgacatctgatagatttctccatccgtccctccgatagaaaccgcactgtccactatataatagttacccggctgctgaagccagccttttagcgcatccagcgggtaaggcggtgtaaaagtcgtattgatcagcactttcccatttccaaagcgcttaaaatcattctccgtcatgatgaccgtattcttatgaagatgtgtcgtgagcacatccaccgtttccaacagcctgtgaaatggcagataccttgcacccttgtcttctataccgggcttgcgggtccggctgaaataataaacatccatctgaaatgcaagcattaattctgcaactgctgtgcccacatctcccattcccacgataccgagctttactcctgtaagctccatttcctcttcctgccagcgcctcggtccaaatccgtggaacaggcgcaccagttcactcgagatgaactctggtacgccctggtcaccatacttccggattccagtcacagtgattccttttccccgggcataactgatatccacattcgcgcttgccggcgtataaaggctgcagcacattccgatgtaccggagatccttacaggcctcaatcacctgtgcaccgatttggctcgtatagaacacaagcacagcttctgcatccttcatacgtctgattttttccgcgtcatcaggaggaatgtcgcggtagatccgtacattttccgcatattcaaacagtgcttcttctgccgctttatcaaaccggacaggttccagcactacaagctttttaaattttctcatctttcttgagctccataaccttcctgtacaggcggataaaatcatcctttgtcgtcatcctcgcattgttgggacggtcgccgcccagcattgcatcgtcggccagacgttccaggctctcttctgtcaccccgaaggatgcaagcggcggaaccggcatatcctccagaagttcatagacacacgcaacgccctttttcgctgcctcccttacggacaaccccgcagtattgaccccgaagaaaccggcaatatctgcataacgctccggccaggcccccatgttgaattccatcaccaccggaaggcacagggcattcgcaacaccgtgcggaacatggtactgcgcccccaaaggatgtgccatgcaatgagaaatcccaaggctggccgtagtaaatgcatagcctgccagcatggcgcccatcatcatatcatagcgggcgtccttgtcgctgtcaccgcggtaaactgccggacgcagggcgcctgcaatcaattttacagcctggcatgccagcgcatcggaaatgggttccgtacagcgggatgtgtaagcctcaattgcatgggtcagtgcatccatccccgttgccgcagtaatacctgccggaagggaataggtcagttccgggtcacagatcgcaagcgccggcatgatcccggtaccgccgatcggcatcttccattctctctgccggtctgcaatcactgcaaacggcgtacactcgcttcctgtccccgccgcagtcgggatggctacaatgggcagcggtgcggtcctgaatttgtcacacccctgataatccctgatgctgccgccattcgtgacaacaattgcggcggccttggcgggatccatagaactcccgccgccaaggccaattatgacatctgcatctttgctcaaatctgcgattttttccacggtctctacggacgaatccggttcacactggtcgtatacgttcagttcgatgcccgcattttcaacagattccatgatctttgcagcaatcccgaacttcaccagcccctgatccgttacgagcgtcgccttatttacacccaattttttcaattcttcccctgtctttgctgcagcaccgtttccaaaaagaattgctccggacggcgcccaagagaaaatggactttttatctttaaatacgctgtaatccaaaggcagctgtgcaactggtctaaacatgataaaacctcctaagcttagtaattttttttattccatcagattaccggatggattaagccttgattccctctttttcgtccttggattttaccataaagtaccggatcacaatcacaaagaatacgataaatcccgtgtagccgcagtaggtcataataacacccagcagcttctgatatggcacgaagaggcacagtacataagtgagcacaccaaatcctacaatcgcaatcttgtatttcgggcttttatcatctttaatgaaaaagttaatggtattccacagtgacggacagattgtggaatatatggccaatatgatgacaaccgcaaacagcgtgcccacggaacccatgatatgggaagccagtgccaggttaggaatcgcaactgttgcagcctcttcaatatttcccaagtggttcagccccatcaggacagaaactgcggaaatgaagaatgcgcctgtaaaaagaatcattttgaaacggccaaatttatattcacgctggtcatatgccagggtagaaacaaagttggaaaccagaagaagggaacagcctccgaaagaaaatcctgctgtcagccaatgattggttccccgggtaatcgtaacagccccgctgtcgagaagggctatgccttccgaaatccgtgggaagaatgtgaaagccgatatcagcccgacgatcaaagtaaagcagacgataaccggcccaagccatccgattacgtcaaccgtgcgcttcaacccgaagattgcggttgctacagcagccactaccatgatagcggtagcgatcggcatcggtacgccccactgctggttaaatgtagatgcgccgcctgaacacatgaagataaaacagcaggctacaaacagccacgcaaagatctcaaataattttcctgcatatttcccggcgtaaaatgtagcaacttcgttcaggttggccagtccgcgggtccttcccgcatatgcatacgctacataagtcagatacatcatcaggaagttgatgatgcccaccgcaatccccatatagccatagcctgaaaagtactggatggtctcctgtccggatgcaaaaccggagccaatcaggaatgcaagcagcgcaccggctaatttaaaaaatgtgaaccagctcatatttttcttatccatatatttgtatccctctctctcttattcttttactctcttgttcttttgttacgcttctttctatgccgcccggagaaacaccactctcccgggcggcttcctgcatgatttattagggcattccgccgcccggaccggtggcgctgccgcaggatatgtgcgataaagcccccataaattagcagcagttggtatgctctgttcgcccgatgatattttcctgtacacgcgggtcaagctctacgaaaaatgcggagtagcctgccacacgcaccattaggttcttatggttctccggatgtgcctgggcatcacgcagggtctctgaatccaccacattgatctgcacatgctgcccgcctgcttcgcagtaacctttcacaaatgattccagcatttccagccctttctcgccctttgcaacggcagggtcaaacttgtggtttaccagaactcccttaggaaccataattgtatccatctttccgatggagttgcctactgcggtcgggccattgcggtccataccattggaaggtgaagcattgttcgcaagcggctccccgtccatacggccatcaggcgtagcgcctacgacacgtccctgccagatattataagtctggttcagaaggatcagttcatactggccaaagcgggaatccttatgtgcacggttttcttctgcacagtaggttacgacctggcggcagtaatcatctactaaatcttcatcattgccgaagtgcacatatttatttaggagcatctgatgccattcctcatgcccctcataattatttgcaagtatctcaaccaattccggcagggtcagcagtttctggcggaaaacaacttggtcaatcgccgccagcgaatcggctgcattagccacgccgctgatgaaggtaccggtactgctgtattttgcgccatccttctgcaggatgcggcctttttcaatacaaccgtccacaagggtagatgcaaataccgtcggacagatctgagaatgaagtgcggaacagattccatatgccttcagatggtaatcaatgatataagacagctgtgtcttataggcatccatgaatttttccatggtatccatctcttccattgtgcctgtcttaggcccaaactggcggcccgtcttcggatccacgccattgaacatcgtcagttccagtactttcaggatattgataaatccggcaacaggacggaaatccgttttgcccggaacctgtgcctctacacatccctcaatcgcgtagtcacgggcttcgcggatatcattgcagccatttgccagtacacgcggaatattaatatcatcattgaagaatgccggctgtccgagccccttctgggtaagctcaagagctcttctgaaggtttccctgtcgatctttttgttataacggaaggagatcgcaggctgtgtcgtctgtgccccgtccgctgcctctaagaacaggtaagtcaggcggttgcacgcattcttaccgtctgcatcaattccgccgatggtaaggttcgtccacattgggaatccggcataggcctctgcttcaatatggtcacgcagctcgaatatttcggtccacttgatcagcatacattcgatcatctcaacgatatcgtcttccgtagcgattcccgcctcaatgtcatgctggaaatagggatacataaactggtcaaaacgtccgaccgaatggttgtgtcccgcattctctatctgatagatcaaatgaatgaaccagaagaactgcattgcctcatagaaagtctccggcggatattccggtacacgttcgcaagtcacggcaatacgtagaagttcttctctgcgtttttcatcttcttctgtctttgccatctcacgggcgagatctgcgtaacggtgtgcaaacataatcgctgcatttaaagtgaccagcatcccctcccatgtatctttctgctcctgggtaataaagtcataatgctctatatgatccagcttttcctgaatctcttcaatcagtttgcggaagcccttctggaaaatcacatcatactgcggcatatggcttgctgttgaaacgatacgtgaaccgattgtaattaaaccgtccagagaggcctgcttcatatcgtctggaatcttactgtctacaatttctctgaaaccatgtcccttccattccgtacaaatccggatcagttcctctttgtctccggggttcacccattccatattgtcggtggagcgggtatcaaaggtgtcgatatcctccagtatccagtttgagccccattccggatatgcgggaacagatctgtatctctcaccatgatctcccacaaaaatggactgtggattgatgaaaattttcatgtttttcaacagatattccagcaaatgtgccttcctggaaatcggagattcaacggatggaatccggtaaaactcggttaccagtctggctctgtccagggaaatagacggatgggtgtcgcgcagccgcgcctttaggaattcaactttgttactgctcattgtgtttcctcctttttgaaaatttgttaatttgtttatcttattgaactttggagtatactgctgtacttccaaagttagcaatcactcacaagcttttctatgatgccgtccatcagcatagtgatgcaccgggcaccccctttactcatctgcgctgttgtcaatgttataaaagcatttctttcctgcaggaattagtatttcattagccgcttctaccagatgaagcatatggccggtatccggctcctcaatatccggcagcggatattctatgtccagtattttatatttgttaatgccgagcctgtggtatgcaagcagttcgtaacgccgtacagcaggcagagtactgataaactgtgccgtggcccggatattttcatccgaatcattccacccgggaacaaccggggtgcgcacacagatttcattgccatgggcgctgatcttttttagattctccagaatctcttcgtttggcctgcctgtaatcttctggtgcattccactgtccatatgcttgatgtcaaaataaataaaatctatgtagtccagacagggggcaaaagcttcataatccccgcatccgcaggtctctatcgcaacattgatgtgatattccctgcatttctttgcaatcgcatacaggaaccggggctgcatcagcgtctcgcctccggaaaatgtaactccgcctccggaatgttcgaaataaaagcggtcctgataaatacgcctgaacaattcatctaccgtgtaatcttgcccaaactgctttctagcctcggtgggacacaactgtacacaaagtccgcaggcagtacactttgccctgtcgtactgcatcacgccctcttcgtccataaagacggcgccattggggcatttcttcaggcagaaaccacatcccatacaattgaccggattcagtgtgatttctggcttaaaagagatgccttccggattagcacaccagagacagtggagcccgcagcccttaaaaaagaccgtggtccgcatcccgcgcccatccctgttacaacatttttgaatattaaaaatcctgcctgtcaactcttccataatctactctcccttgcacgttttttaataattaattatcactttgtttctctgttctgctgttcacttttcattccggcctcaaaaaagtagttgtaatttcaaaacttttgatttataattactcaataattcaagactttcatttgtttttatttgatttcggtgaaataatcagtcaatttttataaaataatcgtaccaataaaatcgttaaaaatccaacaagtaattttcattctgctgttcactttttttcatagggtaaattttaataaaaaaatattatcattttgttcatagtgcacgaaacaccagatcaccttccgcggggttatcagaaatgaaatcgcatgcatgttcataaacatatacatctagtaaacttatatgattctttagccatttgtaagtggcttccaaaagtttccgttatattgcacaatttaggaggtatttatggatactgtaaaatacgaaatttttctcaaggtactggagcaccgcagtttttcaaaagctgccaatgaactcggctatacgcagtccgcggtcagccattccatctctacccttgaaaaatcctttggatttaaacttttaaaccgtgaaaacaatgacatcagcctcacgcgggcagggattgatgtgctccctcacatacgcaatatagtagacgcacagaacacgctggactttacacttacctcttaccacgaatttgaatcaggcacactatgcattgccacaatcccgagcctggcaatccaatgcttcccggaccttctgcgccagtttaatctgcagtatccaaagattcatattgtcatcattgacggcaattatgaagaagtcgaagaaatgcttgccggcggcagggtggattttggattctcatccgtatccgctgagcttccttttaagacgattcctctgttccgtgagagcctgcaggccatccttccctgcggccatcccctcaccgaaaaagaggcactttccctgcacgatctggaatcagaggtatttatcatgccgggtgaaggaccaaaccatcaggttgggcagctgatccgcaaatatcacttaaagcttaacgtcgtctactccgtttccgatgacaacctgactgtctccatgatcgcccagaaccttggcgtcagcattctcccggagatgtcctttaaaaaatacctgaaccttccctttactgcaaaaccactgattgaagagcctttcagggaaatacggattatttacaatgatctcaattccatctctccgatcagccgggcatttatcacgtttgcccagaactatttccgccagtttcctgattcacgaccggtatagcccaggaagcagcgcttttcgccccacgaggcatacgaatacccggctgttatacagctaggaaaatgcccgtagagcaggcatcttgtctgcgctccgcttcggtccgtgctaaacgtgcgccactggcgcacagcacccttcgctgcaggcaaattcaaataggctggatgcgcaacagtttgggcttgcctgaactgttacacgaatatttgacattttgggattatgagatgccttgaccttgtgtcaaattcatgataggctgaatttaccatatgttggtaagtaaatatacaaattaactatatatggttttcattaagatagttaaaagacaaattttattaaggtgatgcatatggatgatcttatgaattattacatgaatcttgttccatttttgggggaggctcttggaaagagctttgaggtggcagttctggactgcagaacagagagtattgtcgctattacaaacaaccatatcagcggtcgcagcgtaggcgctcctatgacagactttgcaaaaaaaatggtcagcagcggagaatggcggaaccgggattacatagcaagctattcaggtcatacagaaaacaacaagcttctccgctcttccacatattttatcaaatccggtgatacccttctgggaatgctctgtatcaacatggatacgacagactaccagctgctcagcaacatagcgcttatgcttggtggtcttgagacaggaacagcaaaggttgccaacagcaataattcagacagtgagacctttcaggacagtgtctctaatgcgattgcccagacactgcacggcctgtaccatgaggacatccccacagagttttcaagaaatgacaggatagcaatcctttctaaactccaggaaaaaaaggtcttcctggtcaaaggatcggttccgcggattgcacgcattctggggtgcagcatacctactgtgtatagggaacttgcacatctgaaaaacttaccgaaccaataaatcgggatttagcaacgggctttagtcccggggcggatggagggggacgcttaccgtgagccgggagatgctgcggcaagtgcctgccctgttggaaatgcatgttagcgagccaggcagcagtaagaggaaatccgcaaaaccagccggaaccgaacacattcaccgcttaatctgatgattaagcgcttcaggtgttctaaaaagctgcttcgggagcagcttttttccggctggttctgcggatttcctctaactgctgccaggctcgctaacatgcatttccaacagggcaggcacttgccgcagcatctcccggctcacggtaagctggttcatccggccggtaggttaggacccgttactaagatggggcctcaaacggggggcagcggatggtattgaattggtgtggatttgatagccccagtaagttttttataattaggttggcggtaaagtaatcagtaaggtataagagcgtttaaaacttacgatctatatgaaagtcccgccaattctgtcccatccgctgccctggtccgggaccctacccggttggcgagctttcctgccgattggatgagccagctttatgacagggaggccggggaggtgctggggctgtatatgccgttgcgatatgctggagtgcgcttagtgattcttgaacagccgatgccagataggcggggaaaaacttgatctccaaatcaagtttttgctgaacccagcgcgggaaatcatcagatttcccgtgatgtgttcagcgtacccgcctatccggcatcgtgtgttctagaatcacttagcagcacgggtgcatatcgcaacggcatatacagccccagtgccttcccggcctccctgtcatgaagcgtccccgtccgtcgacaagtctaaagcttgccgactaaatcccgattttcttgtgatatatttcatgcagcttttcgtatagcggcaccagcttcccgtatatgttttgatacacatcatggtacagatcgtgatatatttggtgctgctccatatccggttcaaatacatctttcaggtgcaccatagcctcctgagcttcttcgtaatttttaaactctcccatgcctacgaatgccgccattgcactccctattccagtggcctcatggctctgcatccgtttgaccggtatgccgaacatatcggccgtgatctggcagatttcatcgctttgggatcctccgcctcccagcctgatctctttgaatgtgtggccggagcgtttttccagtaagcgcatgccgtccattaaggcgaagttgatgccttctatgattgcgcggtacagatggatccttgtgtgctggtcggagaatcctataatggctcctctggctaccggcatcgtcacgtttggcgtgaagtagggctggaagaggaggccgccgcagcctgccgggacctctttcaggcgcttgttcagcagctgttctgcagttacgcccagcagctccgcctgttttacctctttttctgcaaattcttttttgaaccaggatatcagccagtatcccctgtaaatctcgatttccgggttgtaccagccagggatcacggatggataaggcggaataaaccgctccggttctaggtaacggctgatgttgaatgtgattgtggctgtggtaccgaacccaatggcggctttctccttggaaatgcagcccaggcccagtatttcacaggctttgtctgagccggatgccagcaccggaattccttccctgaggccggtatcttccgccgccttcttcgtgatattccccaatagctccccagattccctgacctcgcaaagcttatccggttccacatcgaataccggacgggtcagggcccctttccgctgccagttcctgcactggctgtctattggaaggcgccccaccagacaggctgctgcatccgtcatatttcccgtcaggagaaatgtcagataaccgctgagcagaagatatttctctgtcctggcccagatatccgcctctttctgcatgatccagttacagtgtgctttctggtactggacttttgcagtctcttccatccccacggccttaagcatcatccgtgtgacctgtgaaaacttggggccgccttccgcttttcttttgtccagccagacgattgcagggcgcaggggctttcccactttatccacacaaatgaccgtgtcgcggatcgtcgtcaaggaaacggcttcaatccgatcccacaggctggtttcggtctttaatttctgcgcagcttcacagatactgcggtaataaaagtccgcatcctgctccgcccagtcaggttctctggaaatgtagggcggatcatgcctgatctgtccctttcccagtatctccccccggttgttgatcaacagagcgcgggaactctgggttcccacatcaaaggtcaatacgatcctttcttcttttactcccatggtcttccctccataagggtgcgcttattttcagcagtcccggatgccctaacgaatatcctctctcaaaaagcgcttttcttcttccggcagatccagccccagcgtcccgcccggattcatgttatatccggggtcaaaataattcttcagggcgcggatgacgccgtactcattgcgtccaatctggccttccagccacggtgcgaacatctttccgatgccgtgatgatggctcatggcggccccggacttctgaattgcgtccagaattgttgcatgatatgccttaaatgcctctgcatcgtccattcgtgtaatgaaaataaaatacagattggcgccctgcggataacagtgggacatatgggttgttacaatcgtatttggcagggcatggcagaccttgcgcacctcttcatgcaccctgcccatattggaccagttcacggaacactccagcgtgtctgtcataataccaaagtccagcagcgtatctctgagatacgggtctgtaaatctgcccttttcccagctctttgtcacgtaagaagtcaggctcatcccgccgtactcctttgcgatcctgcggatatttttagccacattttcggaaaatcccttctccccatccgtaaatcccaggaacaggcagcgctccatgtctgcatatccccgggtatccagcagtttccacaggggcgtctcgtctacattatagagccggagcatcagattcgtttcttccgggtcagacaggcggaatacagaggagtatccggcctcgcactgcatcatttcccttgccgcctcctgggcggtcttccagtctttgaatatataagaaaaccgttttctgttctccggcatataccggaacactttcagcgtcacctctgtcagtacgccgaaagttccttcgcttcccatcataatctcattcaggttcgggccggttgcctcccgtggataatgactggtctgtatgtttccgattggtgtcgcatatttctgggaaagcacgatatcggtaatacatccataataggtactgttctgccctgcccccctggtaacgacccagcctcccacgctgctgtactcaaaggactgcggaaaatgaccgcaggtataggcgcgcttagctcccatgagtttctgggcatggttcagcgctctctccagtttcggaccggacatgccgctctgcacggtgattgtctggttcttctcattaaaagagacgatcttgttatagcgtttgcgcatatccagggaaattccgccttttaccggttccacgccgcgggtcacactgcttccgccgccgtacacatagagagggatgctgtgttttgtgcagtatgctacgatctcttcgatctgcttcgtaacgcccggatatacaaccacatcgggcagattttcaatcttgcgctgtctcagcctggccgcatcataaccggtcttcccgtacgccactgcaagccttgggtaatcctccgtggtaacgaattcctcccccacaattttcttcatcgcttcaatatgctcctgcgccagattacacggaacgtccagcttcaccgtatccatcccaatgtctccgtcataagaactgaagtcctcatctgtcatgctgaatatctgtttcatcattttgtaaagggattccttcggatacttcacgtattccggatccccccaccggaaaatagatctgtaactattctttggcgcaggtgttttcacccattttggttcaaaatctttgtacggcttgctcatagctgctcttctcccttctggcatatactgttttcttcttttagaataccgctcgtcacgatcacgtccgcaccaagtcccagtacatttctaatgaccgggacgcccgctgcacatctttcccggaccgtcactttattaatttccctcatcacatcaaaaatccgttctttcggaatctctgccgaaacccgcacggggatcacaggcgttttcggaaaaaccgtgctcacagtggagctgatcgtgcgcatgggatgcgtcatttcttctatggcaaagtgttctccccgtttacactggttgccccggacaatccattttccgtctttctcctctgcttcaaggcggcatccgttcgggcatacaatacaggttaactctttcatgctcccgcctcctttctgactgctgcttcaatcctgctgcccggcgctgccccgaagaggctcagctccagttccagccgttccatctccggcggcttcagattccggtaccttttggtaaagacttcttttccgttcacggtgaacacaaagtttccaactgcaatgctctccctgctgcggaaatagaaaaccaccttctcaccgcctgtacctatgcacagcttctgtggaacaatgtactgcagagaagaatccacagacagctccagctccgcagccttttcggcagtcacactgcctgctgtctctgtcctgctgcctgccccgctgtccgctgtcccttccggtactgtaccgttaccgccgcaggatgcttcaaatgcatattttgcggctgcagttccagccagttcgccgctctcagacacatagtccaccagatcattgacatgcagtgcgttcccacaggagaaaacccctgcagtctccgtcatgaaatgattatcacagagaggaccctttgtgcggctgtccagcctgatccccagtttttccgccatttcattctcgggtatcagacccacagacaaaattaatgcatcgcatgctattctttttttggtggattctattggattcatatgctcatccacttccgccacctccactgccgtcagtcttccctccccgaatactcttgtgaccgtatgggacaaatgaagaggaatttcgtaatcctccaggcattgtacaatatttcgcgtaagtcccgagggctccggcttcacttcgtagactcccagcacccgggcgccttccagcgtcagccgccttgccatgatcaatccgatatcgccgctgcccagaatcacacagcgctctgtcggcatcttcccgtgcaggttcacaaagtgctgggccgttccagccgtcataatcccagccgggcgggtgccgtgaatctgcacctgctttgccgttctctccctgcagcctgtggcaagcaccagggcttttgtcatgtactgctgcacaccccgccggtttacagctgtcaacgcaaacactccgtccttctttaccatctttgttacaaaggtcagaagctctgcttctattttcctttcccggaattcgccgagaaaacgttccacatattccggcccggagagcttctctccaaagcggaccagcccaaagccatcgtggatacactgcttcaaaataccgcccagccttgcttctctctcaatcagcagaacttttgccccctgcttatccgccgatatggctgccgccaggcctgcggggccgccgccgattattatgacatcatacgctttcatatctcagccgcctccccctgcttttgtattttcttcgtatcgcgcagaaggatttcggttccctcccctgcttttctcacttgctcttccggaacctgcagatatccactgatgatcttcgtcacaagaggcatgcagaatccaccctggcatctccccatccccggacggaccctctttttaatcccgtcaaccgtgggaacacatatcggagatttcagggcatccagtatttcccctttactgatttcttcacagcggcagacgatctctccataatcagggttttcccggatcaggtcgtttctttcttcctcagaaagcctgttcagaaccggaggcgccttgcgcacgggatcaaaatccggattgggctctacttccctcttcttttccagttcttccaccaccatcttttcgacgtccagcgccactgccggcgccgtcgtcagccccggtgactgtatgccggcacagtggatcagattccgggttttatgtcctttttctataataaaatcttcctcaaaggtcgcggccctgacgccggtaaaatatgtaataatatcccgttcactcagcgctttcgcagtcattttctgttttgcaaagacggcatcaatgctgtttttgcttgtagcataattctctttttccggcgtctctaccgcattgggcccgaccagcagattatcatgtactgtgtggaggattccgcctccctttgtgtgagaggcgttcgacttccatgtttttatggatgagatccccagcacaagagaacctgctttcttatccaatatggagttcgttccccgcctcgggtgaatcgaataaaatctgtcgcccgccatttccgcaatgtcttcagcaaacacgcctgctgcgttgaccacgatttcgggataaatcctgcccctgtttgtctccacggaaacgatctttccatctgccagttccattcccagcaccgccgtgttcaaagatatcctggctccgttctccaccgcattttccccataggcgatcgtgagtccgtacgggcagacacagcccgccgaggaattgtacatggcaaacttaaattccgggttcagattcggctctttgtgcgccagttcttttctgttcatcatgcgggtatccgtcaccttacaaatgtgttttctctgccaggcataggcccatacagccgggtacatccaccagtctgtgaaaccgacatactgcccgcagcgctcgaaaggaacacttaagtctctgcagaccctgtcatacatcttattgccaagcaggacataatgctgttttaggctgcctttattcagatccactcccggatggacctccccgtcatttctgccggacgcctgcacagccagatccgcctctttgtctacaagcagaatgtccagtttccatttagacagttctcttgcaatacttgttcccgaaataccgcccccaatgatcaagacatccggacggctcccctccagcgactgatcccggaacgatggaagccgcacgggaggtatttccgctccctccaagcagatatcattgacaacatgcattccggactttttgtctacacacatacagcatgccgccacgatgtcatcccagctcttcaaatgaccggagacgacgatacatccatcctccacctgaaccgtgacggcggaaccataacggctgcaaagcttctttcgaagcgatttaacattcatgtaatcccttccttccccttttattccgatatctccggacacccacccgaagccgttttattttctgtatgatgatgtttctatgcatctattttcatactatttacaccatattgacattatacgtcaaattatcagacatttccacccccacttttacaaagggaacgccggtgcaaagtaagaattctgccgcaccacggggagaatagaaagcgggcttactgagagctgtccatttgcggagaacggctaaaggaaacgccggccggattataaagcatcagtggctttcacagcataatcttgatgattagctactcagaccgcttcgacttctgcttcggaagcagatatcagctttacaatccggccggcgtttcattaagccgttctaaccgggcaccctatactttttatgaaacccgctatctttcctccccgccccgcgttagaactccctcctggcaccggctatatctttccttgtatctccgttatttatgaaacagtgaccagtatccttgtacgaatataaacagtacaaccaggggcagtatataggaaacatagattctggcccattttggaaatttgattccggcacctgtattggcttctttgcagaagtttttccatccccatccgatgcggctggtgcagaacaggaggtagatcaggctgcccagggggaggaggttgttgcttacgaggaagtcttcaaagtccagtacgtttgtacctgcacccatgggggagaagccgctccagaggttgaaacccagtacgcatggaagggagaggacaataatcgctcccagattggcgagcactgctttcccgcggctgcatcccgtcagatccatggcaaaggatatgatgttttcgaatactgcaatgatcgttgaggcggctgcaaaaaacatgcagaggaaaaacaaggttccccagatccgccctccgctcatggagttgaaaatgttgggaagggtaatgaagatcagacttggcccgctgtccggctttaccccaaatgcaaaacacgcagggaagatgaccaggcctgcaaccagggccacacatgtatccagaaccgtaacgcagacagcctctcctgtcagtgttctcttcttatctatataacttccaaatatggcgatcgctccaataccaaggctcagggtaaagaacgcctgtcccatggccgcgaataccacatccataatcccggcttcttttaccttcgaaaagtcaggggacagatagaaacgcagcccctctcctgcgccctcaagagttgcggaacgtactgccagtataatcatcagcgccagcagaatcagcatcattactttcgtaattttttccacgcctttctgcaggcccttgctgcagattccaaagcaaagtgctacaacaatgatcatgcagacagccataagaaccggacgggcggtcaacgcgccgaactcaccggcaatctcttctgcgttcaggcccacgaatcttccgcctgccattttaataaaatacagcagcatccagcctccgattgtcgtatagaacatcatcagaagataattgcctgccattgcgccgtacttataccagtgccactttgtcccttcaggctccaacctgtcaaatgataaggcagcgctcacctggcttgctctccccacggcaaactccattaccataatcgggagccccaaaaccaataggaaaaacagataaatcaatacaaacgcagctcctccgtactgccccgtaatgtaggggaacctccagacattacccagaccgatggcgcatcctgctgatatcaggataaatcccagcctggaaccaaacttttctcttttcatttcactcccaaacctctctttagttttgcttgtcacaaatctgcattttcgctgtaatacgctaatatacagacttttcaatacatcaagaataatcttacggcattgggttttgtatgtcaagcgggatgttttttagcacagccattccataaacttccccggcagaactccctaaaactggaagggccatccgctgctcccgtcaggatgcaccagctctgtgcctggcttgccgggaaggctgcggggcaagcctggcgcagagcgtctccctctcatcactcccgccctctcttccggcttccaatctgtccaattacaataacaactatgagtatcaccccccagacaaatgttttcaaagaggaatcgacacgcatgatattgaatgcgctggacaccagctgcagtacgattacagacagcagcaccccaactgcgctgccctttcccccatccgggtttgtcccgcccaggacgacaatcagcagggaaagcaatgtataagagctgccataatctgtttttgcagaattgtatctggacaccatgatcagtccggccaggcttcccagcaccccggatacggcatacgtctttaccgtaaccgtcagattattaatcccgctgtaccgtgatgccatagagtttgttcccatataccgcacatgctgtccatatacggttgaacggagcaggaatgaaaccagcagggcgcccaggataaagagaataaatgcaaccggtaccccagccagtgtgccgtttcccagaatgctgtagccttccggcagcccagtgattgcgggaccctttgtaatcatcagcccacagcccgtgtacagctgcagcccgcacagagttaccagcatggcggggatctgaaggtatccaatcataaatccgttaaaacagccgcagatcgcccccactataacagcagcaatgcacccgaggagaatagacgcagggcttccgcccattttcaccatgatataggctgcggtgatcccggaaaaattcgcaattcctaccagcgacaggtcaatcccgcctgagatcatagccagcatcatgccaaatgaaatcaggccgaattccggaaactgtgtgcacattccctggatattttttatgccaagaaaggaggaaggcgccaggactgccatgattccaaaaataaggacggcaatcagcaatagcatcatgctgtttttatctgaatttttcagtctgctttttatattttccatcgtgccaccttcctatattttcacactattttgtattttcttagttctcagtgaggtgatggatgtaccgactacaatcagaagccctactacaaatgtctgtgcataggtcggaacccccagcatgatcaggttgttctgaatcagtgctatcagcgtgacgcccagaatcgtccccggtatggagccatgtcctcctgtgattctcgtgccgcccatgacaaccgccgcaatcaccatcatctctgttcccatcagaacctgcggatgcgcctgccgcatcaggatcatataagtcacgccgccgactccggccagcgcccccgccagtatgtacacaaaggactgaataaatacaaccccaaagcctgcaattctggccgcattcttgtctccgcccaccgcatagattccgcggcccagcatggtatatttcaggagaatccacaggccgatatagatcacagccggtatcaggatcagtgccgtcagctgatatgtaattccgctgtctcccacatattcataaatgaatactttagaccatcttccaaagctctccggaagacggttgatctccctggagccaaggaatgccagcgtggccccgtttgccacactgctcaccccgagagtcgcaatcagcggcggaactcccagtcttgcaaccagaacggaattgagaaaaccgaacagcattccgatcacgatcgctatcataaaagccagcaccacactgttaagccctgccgcattcatgatcattgccgttgcatacattgcaaagctggctacagccgggaaggatacatcgattccgccggaaatgataaccatcatttcaaacgccgcgaatatcagggttaccagcatggaacgcagcagtgaaaccaccgtggatgcacttgcaaatgccggattgacagccccaataagaatacacagggcggcaataatgtatacgacaatcatttcgtttgcagtcagccctctttttattctgtctttcatactgtctcctcctcacccgtaagcagccgggaaagccttgtctcatccagctcttttgaactgatgctgcctgcagtctttccgttcttcataatcagaatcttgctgcagttctgtatcagctcactgacatcatccgatatcacgataattccaactccctgctctgccagttccctcagtatcttatgaatgtctgccttagaaccgatatccacacccacggtaggaccgttgagcacaagcagagacggattggtattcagccacttggcaatgaccattttctgcgcatttcctccggaaagagtccggatgagcggtctcggcgacttcgcattacagccgatcttctggatccaggcctgtgtcgcatcatacatctccccatagttcagcctgccttttttcaggtatttccgaatggatgccgccacggtgttctcctggattgtacagtccaggaaaagcccctgggtaagccggtcctccggtacatatgcgatattcgctttcatggcatctcctattgacttgatggatacaggcttaccattcagagtaatctttcccccgctggccggagcaatgccgaacagcgcatctcccagttccccgcggccggaacccagaagccctgtaatgccaagaatctcgccttttttcaggtcaaagctgacatcctcaaatgacccttttctcgtaagattctccactttcagaatgacttctctgctgccctcggggcggtaatacacctcatccacatcgcgcccggtcatgcatttaatgaaccgttttctgtcaaactcctcaatcggcccggtcgccacgttctcaccgtttcttaagatggtcagcctgtccgcgatctcatagatttcatccagtttgtgatttacaatcacaattgccatgcccttagccttcagattccttattatggtgttgagcatgccgacctccttttgggtaagcgccgttgtcggctcgtccagaatcagcagtttggcatcatttataatcgcacggcagatcgccaccatctgtttattggctatggaaagcctttccaccagaacatccggatccatatgggcgccaatctgttccattgcacggatggcaagctccctggacctcttccagttcatggtcttcgcaccagtcagaagagcatgattcatagcaatgttctcggctgccgtcagattggggaacaccgcaaaatcctggtaaatcacctggattccctttcggatcgaatcaatgggtgtcagtttccctattttttctccttcaatatatatggatcctgctgtcgggtcatgggctccggaaatcaccttgatcagcgttgatttcccacaaccgttttctcctgcaagacagtggatctcaccggccctgatttccaatcccacgtttttaagcgcctgaactccgccgaatgatttcttaatgttttctaatttcagaaatattttatccataattttcttccacttttcttgagtactcccgaaactctttgtgcccaggattccgaaagcgctccttttataatcccatcggggtatcgtattacttgacgtttccgtatgcagcatttcaggcctgcctgaactgttactccgcatctaagctattaagcaatacagtctgctgacagatatgaaaacaggtgggatgccgctccattgagaacctcccacccctgtttttataatctatgaatcagaaatcgtatgccggatcatctacattgtctttggtcacatcaatccatgcatttccaatcagaatatttccgtccagcgtcatctcattgtaaccttccacaccaagatcaacaccgtcttcgattgtttcgccattgaggagctttacggccgtctctaccatggcttttcctgccagtgcaggatcccagaagctgatcatatcaatggtgccgttctttacatactcgccagcattagaaacaagagccgttcccacaatcttaatctttcctgacatccccatttcttctacagccagtgcggcacctgcaacatccggcattgcggagccctggattcccacgatacccggatttgccgtcagtgcctctttcactttgttatatgcggtatcctggtcgtcagatgtttcgataaggtctccgtattttttcatgtcaggatatttctccttttgcagtgcctccgctgctgctacccattccatatgagacgcgcttgtcagtgcccctaccgtctgcacatactcgccttttccctggcaggagtcgccaagcgcttccatcagatgattaccgtactcgtcgttattaaatgcctcaatgtcatagtctgcgttggtcatgcccggagcctcatgtgtgattactacaatgccctgatcccttgctttctttagtaccggctccagtgactccgtggaaaacggtactacacagatggcatccacgccctgtgagattaaatcctcaatacactgtgcctgcagcgcgccgtccgcctcggacggccctgtgaagaatgcatccaccccgttatcttttgcatactcatcaacgccctcttccattctctcataccatgccagcgccgtcagctttggtactactgcaatcgtgtaatttccatcttcttttttctctgctttatcctctgtctggccgctctctgcctggctgccggaatcctttccggaatcctcgacactgccgcatcctgccaaaagtgctgtcgtcattaccatgcttagtaccagactcacaattttctttttcatattttttccgctcctgttcttttacttttctcctaaagacgccatccacgggaggcccttccccgtcctcttctccgaatcatctgcgttaaaccagagatggcccacttatttcccgttctccgcgtaatatacgtaatccggcgcttcaatccttccgccattgccgaattctacaatcatgcggaggagttcctctgtgctcatgtaataatggttgtctccatcgatccatcccgtctgcatgatccggacttcgtatccgctcagtctcctgcattcctctttgatctcctcatccgggtatacatctttgatatgatggaacccggggccatgcttttcaaggaaatcccagtaaatgttatccccttttatgggctgtatgatctcgatctccatgccgccaacccatttcaccgcacagataaaatcaaatccttttgtaatgtgcacgccgttcaccttaaagtctcttaacttctccggtgtaaaatgcctcacatcccatccgtcaattccaagataataagcgtaattcttcatgtatttttctgcatcgtccacgacaattgcaatttgtttgatattctgcctgtgggacactggtctcttggcattctttgccggatatacttccggagcctcgccgattctgcctccgtttccaagctcgagtgtcagtcccagctgctcgtgagaatccacataatagtggacatcgttatcgatccaccccgtctgcatcaccttgagtcctttctcctccagttcttttacatatgctttcagttcttcgtcatccggaatcacaattttaaaatggtgaaggccgcttccgtattttttcagataatcccaatagatattcgggccttcgaccggctggatcagttcatactctacatctccctcccaggttaccgcacagataaaatcaaatcccgcttcaatgtgttcgttatgtacataaaaatctctgaccgtatccggcgtaaaatggcggatatcccatggtcctattccaaatttctcccagtagtttttcattgctgtatccagatcatctaccaggacacagatttgtttgattgcgcccttcatgtcctaaacttctccttccgtgtctgccttgtaatagatgccccagtcttttctcgtattttctattaaggctgcaatcttcctggtttcttcccaggtaaaatgcgggcattccagcgttttgtctctaaggcacttctgtacttcccgaatctcgaactggaatccggaggctggatatgtctccatatacttttccttagtaccatcattcatgatcagtgtagccgtagtcggatgccaaaattctgaaccgattatgattctgccctcttccccgacaatttccgtctcaggtgtacttacctgattaaatgcacctccaacaaatgcggccccgccatcttcgtactccagcagcatatggaaactctcatccacttccccgttagacttcattgtggaataaacctgaaccggtccctccgggaatgcaagatatgccatcgcaagcgagtagatccccacgtctctgagcgctcccgcagcatgctgcacaccgcccttccacggctgccagtcgtcaatgtccggtttgatatcaaaagacgcgtgtacggccagaggctttccgatcctgcccttttctatccaattcctggcttctattaccgccgggaagcatcttgtccacattccctccatcacaaagacctgtttctcctctgcttttttgaacacttcatccagctgacgctgattatctaccattggcttttcactcagcacagggattcctctgtcgagcgccgccatgatatatgcataatggcagtcattcggagtagctatgtacacaatatcgatctcttcctgttccagcataccctcaaagtctgtatacacctgatcgcagccatatttctgggcaaatgcccttccacttactatacttcttgaaacaactgccgcaagtacggcatcctctacttcctgcatcccttttgcaaattcattggcgatatagcctgtgccagcgaccgcccattttacctgtttcatactatgtaccaagactttcaagcacaagtccgcttgtaattgaaagatgcatacacacagggtgatcggtgtgcctgcattttttcctttcttctaaaattatttcacccttgatccctatccggatttttttactttcgcatgcgttgattatctcttgttctgcagctttgctgcagaaccgcccgccagagcattcgttacggaacattctcagtaacaagttcgtaatgcaatgtcctgtcgaccatgtattaattttatgcacttttaccagtattgtcaatgtatttttatcattttttatttatttgttactaataaacattataaaaacgtttccatagcagcattatgcataaaggaaacgtttccataaaacagtaataattcttattttagtcatttttaacaattctatctttaagcagttccgcccttctgaagatacacgtccgtaatctggtggtactcaatatcctgatctccctgtatcagtttcataattgtatccacacatttcttagccaggagcggaatatcctgacagacagctgtcacaaccggtgtcaccatgcgggtaaaatctgtaccgtcatatcccactattttcaaatcccggggcacctttatccccatgtcggtcacaaaatgatacagcgcgatggcccccatatcagaagcaaatatcccgtctgcctgccgcacttcatcttcataatttttcagcagatctacataataggaatagtccatccggttccactccatttccaacgtgcggactgagatatggtatttattcatcacattttcaaattccagataccggtcattagatggtgtatttacccggaaaaatccgccgatctggatcactctcctgcacccctgttccaccagatattccgccagaatccttccgcccttgcggtggtcagagtggatcagcggtatcttaggccccagatcatggtccatgctgacaatcggcttgtcgatctgctgatacaccgtatcctccacagacagggcgcaggtaataagcccatccacaatattccggtccagcatatcaatatattcctgctcccggtcactcgtcttaaccgtattgcagaccatcgtcttatacccatatctgtacagttctatctctacctggcggataaacgaagcatagaacggagtctggaaatcaggaataatcacccctatgattcccgactttttccttgataaattccgcgcacgttcgttcggaataaaattgagttcacggatcgcttcctcaatcctttttctggaactttccgaaacataaccggttccgttaatcatgcgggaaaccgtagcaattcccacatccgcatgctttgctacatctttaatggtagccatactgaaagacctccttgtatttactgctttcactttctgctgttttctttcgtgactttatgattcaagactaacacaatacacagcgatacacaagaagagatatttggctatgagtaaattgggctgtggtggcgcctgatggaagggcttcatctagacaggaaatttgctcatttttggggaaattatggggagcggcggattgggttgggggagtgtttgggttttttgtcttttatttctttggcaggtatggggatggggagcctgtatatagtattgtgagccggtgcatggctctggtggcggctatgtagaggagacctttatcgtattgggttttgtaggtttcggagtctgcatccaggattatgacttcgtcgaattctaagccttttgacatttggatggaggtgatggatattccgttggtgaagctggtgctttcgggggagatcaggtggatctcgtgatcccgggagagctgtttatgtactgcagcagcttttttgtttgttttcaggatgattcccatagatacgtatccgctttcttggaaggtttttattgcctttttgatttttcggatttcgtcccgggtgtcttcgcatgggatcagctgcggcgcagggccgtggcgttctatgggctctaagcgggccgtctgctggattttctttgcaaatgtgatgatttcgtatgttgagcggtagcttttggttaattccaccaggcttgcttcgcagtactggcggcacaggtcttctatagtgttgagatggttgggattgataaactgcccgaaatctcccaggatggttttgggacatgaaaacaggcggttgatgacagcatattggatgggggtgtagtcctgcatttcgtcgattaccagatgctttatccgcttactttcctgcaggccctcaaaggacgcgtgcagatagagaaacgggtatacatccgcccattccagggtctgctttgcagggaatacgagcatgccgggttgtccaagccattgatagaacgctttatagagggccaggctgttttttatcttcagcatttttttcaggctctttaatatgcttcccgggcgtggaatatcgtcgtccatgaagttgtccgtattaaaacggtcatggatatcttccgcggtctgctgcagcctttttttgattggatatgaagggtaagcaaggaaacggctttgtataaagtcagcctcagcagtaaagcgtccgaaagtataggcttggggttcaaagataaagtggggcagttcctctaagaaggcgtccatcttttccacaaattctaaagtagatttgaagcgcgcccgctcagcccattttgcgtcgttggtttccagaggatctttatccggctcataggcaatgactccctccagcaaaacggcggctatatcggcaaagcttacaccgtaaatgggttcctcgcccaattccggaagaacggtagatatgtaatctccaaagactttattaggcgaaataattgtgatatttcccgccttcagcctgtccttgaaccggtacagtaaaaatgcaatccggtgcagcgctatggatgttttcccggagcccgccaccccctgaatgagaatggttccggcattttcgtttcggatgatttggttctgttccttttggatagtggaaatgatcgatttcatcttttcatccgaagtgtgggacaactcccgctgtaaaacatcatcctgaatatttaccgcgctttccagcgtatattccaattcaccgtcttttatcttaaactggcgtctgcgtatcaggtttccctcaattctgcccatgggggcgtcgtatccagccggtccgggttcacagtcataaaacatcccggcaaccggagagcgccagtcatatatcagaagttcattttcataattgaaagtaaaacgcccaatatagaacttttcggtcctttccctgccctcttcctgaaaatcgatccgggcgaaatagggggaccctttcagctttgaaagtttttcccacacctctgcggcgaaagcccccgtatggtcgatctgcctgagcaccaactcgttttggaacatttcatgaggatcaagctccccgcggtaatctgccatgtatcttttcgcatccatatactcttggtccatccgttccacattggaacgggcctcctgcagagcggcatctaatttcccattgatcatctccaggtaagcggcctcatccgggaactgcacggtttcaacacattcactttccgttttcttatcacttctgctatgctcattcattatttacagcctcctcagataagacaaagcgctgtgtgggatagccaaactcaaccagcagctccgcctccgaaaagcccagtccctgaatctcccggcgctgccctgtatccgctttatcgccctccctgaatgtggtaacgctgatctccttccccacgaccagttcgctcaaaaccttctccaaaaaagccttcggaatccctttatccctgtaaagagggtgggtccccataaaatcaatgctcccgttttcatatgaaaaaagcataatccccaccgcaatcgatccgtcctttaaaatgagagcctgcctgcatctaatccgacgtttcagctccgcctcatattcatcttcatacaaatgcggaaacccatcaataacaagacgcaccagatccatccagcagggaatatcatcttctgccgcaaaatcaatactccattccataagatctttactttgaagcattccatattccccctcaaactgaaatctcaactgcaaaggataaaacttttcattcctgcgatattgattgggcggcagcttatacatctccctaaaaatatttgtaaatgcctgctggctttcataccccgctgccgccgcaatctcaacaatcggtttctcagaaaaaaccaaaagcttagccgcttccgtcagctgcctgcgctgcacataatcatggatcgtcagcccaaccgtacgcacaaaaactctgtgaagataatacttagaataatgaacagcattcgagatacgatccaaatccagtttttccatcaaatgctcctcaataaactcaattgccgccgaaactttcgcaacaacattgttatccataaaaatctcctcctttcacaattcctaatattatcaaactctacaagatttgttttgcgcattcttgctataaccatccgtctcccccgccgaatcccccgcgccgcctcccgtccggatgcacccagctgggaaaagcggttatggcttcctgcaaagctgtgtatacccaaagggcatcccttcacgcatcccctgcgggcggagccaaaggaaagctgcggaatcatgtatgccgtttcagaaccctaaaaacgcgcttagaagcagttacagagaatatgtggggaatagagggcaggatttgattcacaaaatcaaatcctgttgccgccggcggcccgaatgcatcggcattcggaccaactgcggcaagtacctctattccccacatattctctgttactgcttcttagcaagtggcgcggattctgaaacggcatacatgattccgcagctttcctttggctccgcccgcaggggatgcgtgaagggatgcccttttgggtatacacagctttgcaggaagccatacccgccgttttcccagcgtcctttcccctacttcatcctctcaacccgttccttgatcgtcttattaaagttctctacctgtctgcagtaagtctcattcataaacttagaattcagcataaaatccgctgttgccaggttattcgcaatcggaatatcataaaccaccgcgattcgaagcagagcctttacatccgggtcatgcggctgcgcctccagcggatcccagagaaagatcataaaatcaatctggccctccacgatcttagcgccaatctgctggtcaccgcccaggggaccgctgcagtagcctttcaccggaagcccggttctttccgaaatcaactttgccgttgtgcctgttccgcataagaaatggctctttaagatgtctttatttctgtcacaccaatccaccagttcttttttcttgccgtcatgggctaccagtgctatgtgctttgcttttccgatttctaaagttacgtaactgtcttccagcataaataatacctcccaattattgcaggaccactttcgtgaactctcctgcagctcatctttttcaaagtattgtaatcgtctgtactatgccagctgctccatagaataaaaacggatagaggccagtaaaccgatgactactgtcactatcatactataaatgaaaataattggaaagaccaaatcaatattaaccataaatcctgctgccagcgcaattgcaagcccgattccgaggaccgtcatctggaaaatggcacgcacaaagtcctgcccggttttacccagtgtatcgcccagaaggcactgtgcaatgactttagtatacagccggttggcctgcagtaccgcatacgtcagaattgccaggatgctctgaacaggcccgatcccccacgctatactcaaggggatacagaaaatacatccatccacaagggccttgatatgctccatcaaagtcgcgtaccacaattttctaaccggactgtccggaatcagaaacagatagggcgtcttcagttcattttcccattttccgaggtatcctgtcaggatcagtgtcatgtacatgataatacccagcatatacatctgaggcacccctgattttaaagcgctgtctctcataacgcgggaaagcaggatcgcgatggccaggcacagcagagtcattttggaaaatataaaatacttttcctttttgtattccagcagctgtctgtaaaaaatggcctttgcaccggttcctttgtatgtgtcctttacccgtcggaaacgctttttcttctctcccatcgacatgaccatctcgccgtttactttccgccttctcatttccgcatagtcatctgcaaatttggcggcatcctcgtaatagtcgccatcgcatttcatacggacggctgccgcgatcatcaccgccacagccagcagatacagcacggtacagattacattcagtacatccgggcccagaagaatcaggcggtaaacggagatattccagcccacaaccggtatcatctgcagcccaggccagtcgaaaaatgcagacgcagtctcgagcgtaacgccctgcttcttaaaataaataacgatcagaaccgcaactcccacaagaaagatcttaatccctgtgctaattgccttcattactttttgcgggattttatcattcgtgtacaagaagatcatcacactgacctcaaaaaccgtttccacgacgcactccaccaggaaaaacaggatcatcttccacggtgtaatgccaaatacggtaagtcccgctatcaggaataaaacgctcactacaatagtaagaagatagttcatccatgcactgtgcagcaggatctttttcgggctaatcggtgcggtaaatacaaagtgtgcatgggatggcttgaaaataacgccttttttagaggcatagccagcaaaattactaaggaaaatatataaagtccaaagtgtgatgatgacagtcaaaccctttgccgagctgaaatgtatctttgttacgatctgccccagcataaccgccaaaaaaataccatatacaatacagataatcatgaccagcagagatgccggctttttcaccgcttttttcaggttgtttataaaactccgtttcgtaagatataacaatgccttcatctatgcttcaccacctgtctcccagttaccggtcatctcaaagaagagggcatccaggtccttttccccgacctcagacttctgataagaacctatgatatggctcttttccatcacaaacatgacatcccacagctcttctaccatttcaagcatgtgtgtgctgatcagaacggtaactccctggtcacgcagctcgaggacaatttctttcagttctttaatcgccctgggatccagaccgaccatgggctcatccagaagaatcaccttgggttttatgacaagcgcacagcagatgctgaccttctgcatcatccctttggagagttcattgcccagcttatcccgcttgtcatccagctcaaaccgctccagcagcgccgtaacctcttcctctgtaatactgctgccatatgccattctcacatattctatatgctccctcacggtcagcgcctcaaacatagaaggaatctccggtacataggcaaacagcttcttggcttccatctgcttggccgggattccctgtatgccgatccttcctttgtacctcaaaagcccggcgatgctcttaataatcgtggactttcctgcgccgttcggccccagaagaatccccacctgcccgtccgggataaaaaaacttacctgatctacggcaagatgtttcccataggatttactcaactcttgtatctccagcataacttatcctcctcataattctaaatttattacagtcaaaactctctttgttcgagaaacttaacagaaagtcccgcagacaatatcaaaacagctaatcccgatactatcaacagtacggatatgcctgtattcattacaattgcttccgcaatcagatttttcccaattatcgaaaacaaagccaccagcccccatgtgggcagcataatcattacaacaagcagcgccattttgatttttgtataggaaaaacgaaaatacagcgggaaaaaaatacttaaaacaaccgacatagccaaaaatgtaaccgaaagcgaggagagagtcaagtcctccctcacgaaaactatatttttaagcgtaattttagaaagcaaaaagtataaaaacatttccagtatagttagcagcaaacccaggatatattttacggccacaatcatgcttttcttatatggaaccgccagcagatataagttgcccttatacttatcctccattaaaaaaatgttgttaaaaaggaaatagctggcaaagctgaccgatataaacagaatatacacgctgctcatatgaacagactgattgcttaaaaatatcgggactgcaagcagtatcatgatggaaaaaacaaaatacatccctgccagtaaaagatctttttttatgagatgaataatcttcatgatgcgcctcctcaccctattattttcagcattgcctcttcgattgtaggatccggaagctttgattgtctcaggaactcctctttcgatgctgcggctaatatctgcccttcatcaatcaggatgatgtcatccccgattttgtccagatcagaagtaatatgcgtagaaaaaaagatcgtcttccctttctctttctgttctgacaactccgtacagaatagctgacgcgtcttcgggtccagaccgccggacggctcatccagaatcaggatctccgcatgatgggataacgccagggcaagcgcaaatttcatcttcatgcccttcgaaagtgtatcaatcctctgcgtctcctttagtccgaacttctccatatacctgtgatattccgaatcatcccagccggcataagccccggccacaacgtttttcatggcagatatggtaaacttatcataaaagtatccgtcatcaaagaccacgccgatccgctctttatacgctcgttcattatgatacatcgttcttccctcaagaagtatatgcccggaatcatatggaaccaggcctaagatgcatttcagcgtggttgttttacctgcaccgttattgccgataaaaccggtgatccgtccctctctgacagtaaaagaaacatgatccagagaaaaagatttgtagttcttgctcaggtttgatacttccagcattcttcatccctcctcatctctaaaacggattatgtatccatctatacagcagtaatttcactctatacggtatctgtattactcatttagtacaataatacaatgattccatcatcttgtcaagtaggtgttatccgcttaagaatagtactaaaaacctttattacttttcacccccaagccagtatcagtaaatcggaggttcgccggcaagctttagttttgcaggcggacggggccgcaaaatgaagggatagccgcaaacctgccaaacgcagatttgcggctatcccttcatattgctgggctcatccaatcggcagttaagttcgcctactgagggaggctccgtaaccggggcagcgtattgattcgtttggtaatactgaatccgcgtccccaaagcgggttcacttactgccctctgttctgaagtaggaatgatcgatctccttccagttattgttattttcaggattcacgcccggccatccgccgctggggctcacgcatatgtaatatttaccgtcaaagctatagatacttccctcctgcagcttactgccgaaatggtctccacctataatgtccgcctctgtaatcaactgatcatttaaaaccagaactttcgtccaattgttcgtgtaatttttaatctgcgccatgctgccgcaattgtatttctgggtaatcgtatcctcggttacataataatatctttgaacgctctcatcataataaataccttgcggtacttttatgatttctgtatcattcggcggtttcatcgcatctgccagatcttttaagtcctgaaaggtcggcactccggcatggtaactcaacgtaccgccgtcttccggcctgcgctctgtcgtgccgatcgtgatgtggcttcaaattccggcaatccatttttccatctgtttccccaccattatcacggtttattaagcatatcgtaacagttcaggctgaccggaactgttacggagtatcatcaattgcaaaatcataaattgttatgttgcttcccttggtaattcctattttctggcttttcagatccaggttttctccttcgtataccagctgcagggtcatttcctcttccgttttgtttaacaccgtctctccgctgtcttttgctccgtgtttctgcttgtaataggatgaataaacagcctctgtatttcgcctcatattctgggaacgcgtgaacagcttgtaggactgtgagattacttttgtgaaggttccgacaagcagcaccaagataacaaatcccacaaccaattctaccatggtagaccctttccgtttattttttgaatcaaagggatgacacgtttttctgtttttcacttcattctgcatcttactcttcccccacttggtcgccagtatctgtcagagttatattcaaactggaatagaactccatagttttcgatggcacccgtctcatttactgtgtacctcttttcgccggcatcccatgccgcagcgaattccacggtatgctcatacccattaccggtatttgaatactggatactgatgccggaatcctcttcctgccatgcagcactgcatgacgtttgattcctgcagctttgtttcaccatatccccggagtcactgcggtaccagctggacatgcttgccccgccttctccggtttccgcatcgcaggacaggaatgtaacttgtctggtgtcctggttccttgcaaaattctcagatacgattcgatccatatccggcagagtgagcataaatgccgcgccatcctgtgccagctgcccataggtaaccagcgtactgccttgaccctccgtctccaattttcacggcagtccgatggttctgcctgcgccgatgtctcctaaataataaacattttcatcataagcactgcatgaagggtaatactctcccggggctggtgcagtgatcatggcctgatccacatctgcataacgattgtctgacttttgcgaatctgcaagcggatatcctgctgacagatctgtgtccgacgtatccctataaaatacatgataataagttccgttcccctttgtaaactgcagcatatagatctgcgccgcctgggatgcacccgatatctccgcggtgtaatcggcggcatccggccgtgtattcatccgggcgttgctgccatccacttccaaggcagtcccatctcttgcagatagagaggccagagcatcctgtccgtcgaccgttcctgtcgtacctgcaatctcagttacttcgtccgtcttctggtaccagcttctgaaggcggagtcttcataccgttctatatttcctgaaatgccttttgccattacctgcgaagtcctgatatcctctgaagatcctgcgccattcaccgtttccggatccgccagtacaagaacaaattcctgttttccttcttcggatttttggcatttcagataagatgctgcctgtctgctgttctgggagttgtggatgacctgcagcaaatagcgttctgcatacgattccactgtacaggtcagcgtagtctgttctgtcctgttgtcattctgcaccgccgtatctccttcgtaatgacctgcttccgtatataccacgccggttcttgactttgccatatctggaaccccattttggacacggggtatcctgaattcggcgtaactcctgctatacttgtattcatgagaccagtaggaactgatctggctgtcagataccgcacggacagccgcagccatatacatccccgcacaatcggaaagcctggacggcagctccatctcacgggtgacacctgccggaccgtccttgtaaatcacggaatctttatctgctaatgctttgaccgatacattgattgtcataccgcctgtaaattcactcaggtcaacgcttcgctctattgcggcggaagaaactctttccgccccgctcagagataaaaatgtcagatctctctgcgtgtgaccgcataggaaccatctgcattttttgaaataactacggtcttttccacctgtgcggcctcgcgatagatatcctcgtctgatccttctattttcctgctgtatgcagccgtacctgctgtctcatctgcagattcctcataaccattttccctcagatcttttttcagtgcttccatttcctctgcgctgtactacttactgcagaccttatcctgtgcgctgcgctcgatggtaacggcatatcctgccaaataatccatgatgccttctgaattctcatccgcggcgtctgtctgtgccgcctgatccgccgcattggcagctgcctgcagcgcctgttgttccacaatgtactgttctgtatccctgcacatatatattcccagagtcatgccaagggttctagcctcagactcttttaatgtctaaagtaaaatcggtaattctcattctcggctcatttgccgcgcagtcatccacattccctgccttcgcgtcaaagctcagtaggccgttctctgcatcataactgctgatctccgccgtaaccagccccgatgcacaggaagctacgacctcttcggttgcgctgtccactctaggataggccagcacactgctcttcaggctcgccatgctgttccccagcgaggaagccgcctgcagttcttcattcagcctgtcgtactcctcacatgccgccacaacatcctgtgtcagttcctgactggcagcttttccaagcttcaccaccggctccagctgtaatgcaaccgcttccatctccgcatcaatctggtagatactgtcctgataaatctgcagttcgtcctccgacaatcctgctatgtacacctgcggaatcttctgtgccaaatcctgtgccttggcaaactgaagaagcgcactgaccgtacgcgccgtctccgcagcaaactccggggttccggactcggaaaacatcctgtttctgctggaatatttatattcaccgttaaccagaagcagattgatcagcggcatgtcgtccgcaaactgtacaatgcaggttgcgtcacttagctgaagaagcttttcagccagcctcatggtcacgcccactgcgttctccacaccactgattgcaagatccaggccggcaaaacattccacatatccgtgcacaagttctctcggcgctacggatgcaaagacctgttttagcttttccttcttcctctcgcccccggatagcgggaagtaaccgtaaaccggattggagattcgctccacatccgttaattcacggctgatatattccatcaactgtcttggcttcagagccgacacgtccaccactttcgtagtaaactggctgctgtcgatcaccagatatacattctttcctggtatatgattggtctcccaaagattccggatcatttcccggaacccgtcctgatgatcagcatgattggctctacatacgacaccatcttattgatagcaatatccgcgtcaaattccatggcatccgccgtcggcaacggcagagtatccatggtgtcaaacagctcctggagctgcggcataactactttgtgagtaccatgataaccgcaatgatcataacaccaagtatcttaaggtacacaagggagctggatatctttccgttcaggcagtgctctttctctaacatcaaagccatctgcatggaaaccagttccagattactgctgctctccgcagagcggtacatataaatcctaagagggggaaacgccccgttctgtgactccatcgcctccgaaagggatattccctgccggatttggcgtatcatgtcttcatacacctgccgttcattcggcttaatggactctccgtttgcaatgatgttgagcgcccgcaccaaagtaacgcccgcaccgaccagcgtggacaactgcctggaaaaatccgcctgcacctttgccttaaactgcttccggttctttccgaaccgcacttcctttgctgaaagcagaaaagcgtcctgctcgtgcaacctgagctgcagctccgcctcgtttcccgcattcatggtgcccaacatcttttttccgtctatcgtctgagccttatacttgtattgtgccatcagacgtccctccctgattccctaattttaggtaatattttactatatcagaatcgccagataccagtcaatcatctggttcccgaagagcaggcccagtatcatgcccacacacagaaacggcccgaatgcaaactgttccttgcgccccttctttcctgatgccagcagatagatcccatatccgcctcccaggaggataccgataatcgcagatgccagaaccgtccgccatccaagaaacagcccccctgctgccatcagcttgatatcgccgcctccaaatgctcccgggacagcgatcgcaagaagcagcatgggtacgctgatgcacaccattccgatcagcctctgcccgatcgtaatatccttcataaaaaacagtcccgctgctgtcagaactacaatggctatggagcagccgtccgcaatctccatggtgtctaaatccatcagtgccacaacggtcagaacccctgcgaatgcgaagaccagcactgctttcgcataatccccgccgtcatatccatagtatatggcgcaaaacagtgcggctgcacctcctgctgcctcggtaagcgtgtccctggctccaattttcccgccgcagtagcggcactttccccgcaataatagatagctgaatatgggaattaaatccgctgcccctagttcatgatggcaggccggacaggctgaacgccccctgataaaagacattttcttagggacgcgatagacaatcacgtttaaaaaagaaaacacacaggcgccggcaaaaaacaaaaggatgcacaacagcgcttcacatataataaaactcatatttattctccgaatcttgtttcaaaccacgctcggtgatttcacattgaattatgtaagttaaaatcttcttatgaaaagaaaaaaggtatttgtttccactttttccctttcataaaaaggggaattcacccggttacaaccgaacaaattcccactcctcatctaatcagtatattgatgaatcttccagtagacttcccatgtaacagtatcatcagttgcatcatactgatactgcaccaaaaatcttcccttccgataactcatggtatctacgcagttctttctggtattccatgaaactaaatggatctgtccaggacaacattcttcgcttcacgcagagcctgccgctcctgaactgactgattccatatccacagggtggtgcaagaaccactgctgaaataagcaggactatgagggctgttttgcatgtatatttcaataaacttggtaccagaaccgctgcaagaatcaatataattacaattacagcgatcagttcaaccgcgtaaaccctttcttatttttagccttctgtcttaattctttaaacaaaaatttttcctcctggataatgttattcgtcctccctttgcaccgaatagattcaatagtatgactcccggaaagaccgcatgtcatgcatcatgacatgcgtatctgatactggttggatttaactcccatttgtcagtctgtgtcaataagctgttgcgcatttggcaaattacttattagctatcataagttttgaagctattatttacgctttctttgctcttcttccacactttctttgcacttttcatctcaaaatatatattctagcaaacacgcccgtttatttcacttttacagcaccaattgtgctaaatccggaacacttcctggtcatccggtacatatagatttccgctgtaatattttcttccttcttcggtatatagttctttccgttcctccaaatgcgtttcttccgtatgataaagaatcagatttgggattctcagctgctctgccagcagacatgcctcctttaccgtactatgatgtttttcgtatggcttgaatttatctgcttctctataaaggcagaatgcctcatgcatcagccagtcgctgtctctgacatactcctcttcacacggattatacggttcatccccgcagcaggacagctttttcccgtccgcggttttcaaagtaaatccaaactgccgggcctttgttgatccaatatcaaaaaaggtaacttcgcagcccagtatctgtttcgtatccccgctttcaagcggaatcagctgaatacgccctccaaggtgtttcgtcacctttttcatgatcgtcagttccgctatcgttgtaatcgtgaggatcaggccgctgtggcagtaaatcctgaccttcccctcatattttccctgattgatgttctgcccgatcattcttatcagccagaacaaccccagcagatgatcaatgtgctcgtgtgtaataaatatatcatggatttcttccaacggtatattcgtctccttcagaatccggaggatctgattgccgccccctgcatctaccagaaaatgcctgtgttcctccgacaaaacaaagcacgtattatagcagtctgtcaccgttgcatttccagtacctaatatcgtcaatttcatagtctgcacccttttctactgtacgtttcccaccgccccttttaagcggcctgctgcctattcatagtacttcatcagcgcctgtgttcccagctctgcgtatccttccgcttccagttcttcacagttagcaagcacctggctgagcatccccaggtccagctcactcatatttgcctcaattaaagccagtttcatatccttgataaaatgcttcataaaaaagccgggcgcataatcgtcaaccagaatctttggcccgaatgtatccagctgtctgctgcctgccgcaccagtggatactgattttaaaacagtttccaggttcagcccttttgccctggcgtaggcaagcgcctcacagactcccgacagcgccccggcaatcataatctgatttgcaagcttgcagtgctgtccgcagccagcctttccctgataattgatatttgtccccatggcttcaaacagcggaagacacgcttcgtagtccgcccgatccccaccggcaaggatagagagggttccctcttttgctccggtatcaccgccagttacaggggcatcaattacatggaagcctttctttgtcccctctgtatatattttctccgcgatctgcgggctggtcgttgtcatatcaatcaaatatgcgccttcgtccgcactgtccaaaatattgcctgcgtcaaaatacacctcttccacatcctttgggaatcccacaatcgtaataacggcctcacatcccgccacacagctcttgatcgagtcatggaaaagtgccccctctgcaatcaaatcttctgccttcgctttgtcccgtgcaaagatatgcagttcatagcccgctttcattagatttcgtgccatggatttccccatgattcctattccaataaaccctatcttcttcattctatcaccctcgtcttcatattgccggaaaatgatttcaaatttttccggatcttaattcgtattttgttttattgcttcagctgattcatgattttactttatactgcgtaacagttcagacaggcctgaactgttaccacagagacttactgttttattatagtatattaggaaacctgtcacaatagagaaattatttttttgtgtatcataccgtcaaatcacattgtaatcttccgttgaaaatgctatactgaacacacattttacaaaagagaatatctggggaggtattttatgaagcggaaaaaaggcgggttcaccttagttgaattaattgttgtgattgttatcattctagtattggcagccgtcctggttccttcacttttaagatatgtgtccaaggctaaaaatgccgccgctattaatgagtgcagcgaagtacttcaggctgctgccaggactgccgttgatcttgccgccgagggaacccttaccgcacagatcctgaacgacagcaggcctgtaatcttgaaacaggcgaatgccggcgggtcatttgagactactatacagtttgaagacgatgatgcagagatcttatctttcggatatttatcggaaagcaatctccatgtaatttatgacatcaagcatgatccccggatttacatagatgttgaaggtaatgctacccttaccagaatgaacaattttataaaacaggcgagtgactttgttacagggcagaaacaggataatccaaagctaaattctctggaccgcctcaggcttatagaaaatgcagtaaataacggcgggctcttagcagttaccgaatcccagaaaaagggcacgccctatgaaaaaaacgaattatattggcatccttattatttaggcgatttcaaacaggaaaaccctccggttgtcctgtttgccaacacatcatctaccacacacggcggctggtcagctaatcttatctatgtagacggaaaagtatatcaggctcctgaaaagaacactgtgaacatagcaggctggggaacgggcacctctcctgtatatgattacaattctttgaagacttggctggacgaaaataagtacactgcagtaaactaaatcacctcatataaaatataaaccatctgccaaccggctggcacagccggccagcggtggtttttaatttgctcatttatctgcaataggaaaacatcttctggcattgataccaataatatattacaatatacatattaaccagacaggaggactctctatggaactttccaggcagctcgcctcacagattgttaatgcagtctacgaggtggttaaaaatgacatcaacctgatcaatgcctttggcatcataatcggcagtacgaacccacagcgaatcggtactttccatgaggccggcagtgaagccgtgaaaaccggcgcgcccgtatacgtggacagcggacaccgttttaaaggcacacagaatggaattaattaccccatttttctggaggggcagccagtcgccgccatcggcatcaccggaaatccggatgagctccggcagttcggcttcctgattactaaaatcacagaagtttttctcaaggagcagcaactgaatgaagaaatgctctctgaaaaccggtccctgcattatcttgtaacttcgcttatttatgacaacattcagaatcagaagcagctggaattgctgttggataaatacgagattgatcctgctcaggaatatgccgcgctttctataaaaatgccggacaccactctggagcctgcgctgcgtttttattttgccgctctgggatgccggctctccctttatctttatcccaatgagtgggttgtcatatttgacagggaaacctttggccgtttttctccgtctgaatttggcagcaggtttcaggaacgcgttcattccggcatggggccattttgtacactctatcagctgcaccagtcctatcgcagtgcccaggccgcccgggaacatgcacagcagcggaacgccgtattttataatatagaagacatttccattgagtttgtcatggaaagcctgccaggcagcatacagaggctttatgcggaccatgtcctgaagcagctgaatcccagggagctgcatatcttgaaaacgtacttcaactgcagcctttccttaaaaactgcttccgaaaaactctttatccacaagaatactctgcagtatcaattggacaagatcgcagaaagaaccggactgaatccacgggtattccatgatgctttcatgctgcagttcgctttattctgcaagcagcatttataaaggtcattgtttattcataccactgtatgcggggatgattttcaaacaagttttattactaataacaaatattgacgggatttttttctattttcagtatctgtaacatagccgtacactgaagttttgatataataaatacatacaggacatcattgtttctgtgtctatacaaaaaatagtaaatgttattagtaagcgacaagatgtgaaatgatataagcccgtataagttggggcatctattgttgattatgttagtaaggtaaagacgatgcctttttatgcagtatttgatgagcagactcctgttggatttgctgcgataaaaattcataatacatttacagccgaggtgtgcgtcatgggcgttatcaacaggtatcaacgcggcggattaggcacaagacttatatcggctgtggaagaatattgttgttccaacaaattcgaatttttgactgttaaaacattagcccataccgttcactatgaaccctatgagagaaccagaaaattttaccgcaagatggatttcgtgccattagagatttttccacttcattgggatgaagaaaacccatgcctatttatggctaaaaagctatagtccattatgaacaaaatgggatattccgtatgtctctgccttgcggcaaaatggcattctactgcgtaacttttcgtctattcaatcaataaaaaattaaatttcaaatatggaggttttattatgaagatcgtagttgctgttgattcttttaaaggcagtttaagttccatggaagccggacgtgcaatccaagaaggtattcaaaaagccagtccagaagcaaatgtaattgtcagaccgctggcagacggaggcgaaggtacaaccgatgccctcatagaagggctgggcggggagcgtatagaactcactgttacgggccctctcggtgaaccggtgtgcgcctgttacggatatctgaaagaaaccggcaccgccattattgaaatggcatctgccgcggggatcactctgattccaagagaacaacggaatcctttggccgccaccacctttggtgtgggagaactgatcaaagatgccgcagaaaaaggatgccgcaattttatcgtcgggatcggcggaagtgcaaccaacgatggcggaatcggcatgctccaggcacttggatatgaatttctggatgagaacggacttaaatcaggccaaggcgcccaggcccttgcaggaatttccagcatccgcagcgaccacgtcttcccatggctgtccgaatgtacttttcaggccgcctgcgacgtaaccaatcccctttgcggtaaaaacggcgccacatacatatacggcccgcaaaaaggcgttactgaagagatgaagcccttactggacgcagccatggatcattttgcccaaatcaccgctgacacctttggcgtcagccacgccgccgcccccggagccggagcagccggaggactcggttttgccctcctcagttacctgaatgcccgtcttacccccggcattgacctgatcttgagtgcagtccgcctggaagaagaaatgaaaaccgcagacatcgtaatcaccggagaaggccgccttgaccaccagactgccatgggcaaagcccccgccggagtggccgccctcgcaaaaaaatacggcgtcaaagttctcgcattcgccgggagcgttaccccagatgcccgggcctgcaacagcgccggaatagacgcctacttccccatagtacgtggaattaccaccctggaagaggccctcatcccagaaaatgctgcccaaaaccttacagacaccacagagcaggtcttccgcctcatagaggcactgtcaaacgagagatactaataaaaagggactgctatatggaagatttacatagggcagaccagctgcacatctacaaaccaaccgccaagtcatgcccatatgccgccccccgcctgttccgcgtccgaagtgtcggctttcccgcccggatgccgctctcgggcggctttttaaaaaattttcactgcaatcatcgcaatccccagcacagacagaacaattcccgtggcccggttcaggaccttcgccggggctttattcgcaaatttagctgctaatctcgcgccaaccaaagtaaacaaaatacataacacgagggcaggtatatccggcagcccgccgctgattgaaaaatgggatatggcgcctgtaaaagccgtaaatgccatgatgaaaacactcgtccccaccgctgtcttcaattcatatccaagtatacttgtcagcatcagaagcatcatcatgccaccgcctgcaccaataaatccacagataaatccgatcacgattccgcacagaattgactggataatttttgtcctggcgcttttttcctcctgcttttcttttgtcgtcataaccggttttactataaacttaatacccagaagcagggtcataaagacagaaaagcttcccattgtcgtattcggaaccaaagaagcgatataactgccgaacagggtaaataccaggactgttaggagcatcacgatcccgtttttgatatccaggttcttatgtttcccatatgtataagcagaaactgccgatgcgagcacatcagatgccagtgatattcccaccgcctcatatgcatcaaatcccagaaaagtaatcagcatgggggagatcaccgccgctgcagaaagccccgccaaccccgttccgatcccggcgcccattcctgccgccagacagacaagtatcttcactgtcatcattcctcacctcgtttcatggtctccaaattacttgatatacggtagagaatctgatcaaacatctgcctctcttcactcgtaattcccctgaaaacgctcttcataacccgggcctgagcctccagcgccttttcaagcggcccggctgcctcctttgtaacctgcagatggctgatcctccgatctttatcatcttccctgattaacagcgcccctcttttcaccagtaattctactgccttagatacataagatttggctatatgacggtactccacgatatctctggccgtatcgtactgaggattattgtgaagaaataaaagtacatccacttccactttactcatgccgtacccggctgcaaccgcattgatgcttccgctgtacagcttattgaattgatttgtaatggataaaaattcacttatagaaatcatcatcctgcctcctgatttattaattaaactgttcctttttaaatcaaatatagttcttttaagaacagttctctgatgaactatattatcataaaacaaaaatttgtcaattgattttaaaataatagacgttttaaaaaaaacagttgaaattcgagaaaaaaagagatataataatcaaggttcgtctgacgaaccattggctggaatagctcagtaggtagagcacttcactcgtaatgaaggggtcgtcggttcaagtccgatttccagctttcgtaaaaaaggccgcaaacccggggtttttaaggggttgcggccttttttatatcattggaaaagatagataaggaaccagatctattcaagataaatgctgaatatcacaatcatctgaaaacggatgtcaaagatgatatatatcaagaagaaaactccgtgttatgaatattttcagaaattctttcgataaatgaatattttagtggataagcggcacataatgttgcatattcatcatgaaatgtgttagtatatgtacaagattggaactactcctcaaaatagttcctttcccaccacattcaagcccggagtcctgaagattccgggcattacattatttgaatcacagcaaatgtacttctcattttctggcctcatcatgaagaaaacgatggttgcagttcgccatctttttaccactatccctccaaaagagaatctattgaaacctcaaaaatatctgcaatcttcttaaccatataaatatcaggcaaacgcttcccccgttcataatttgaaagagtcgtccttgttatatgcagaaatcttgcaagttgctgttgtgtcatgtgtttctgaatccgtaatttacgtatactaaaaccgatatctgacataatatcgaccgccccccatatgtctacattatcatgctttcctagaaaagtatacgtaacgtgtcgtatattaactattttcatttgataacgagttcatgctgccttgtataatgacaaatcaattttgaaaatgtatctatgtacggcatatgaaaacagtcattcactgaaagtattttaaatacatttctaaatcttctcttttgcggaatcttctttccttgcttattgaatatgtctatggtacaatacaaaaaaaagcaatttagatataaaagaaaagttatttttaatggaataattattaagtcgaaaatgttttatggaataggacgtgtaagttctaaataaggttaaaaggaaagggaggtatcatatgaaaaacaaaatactaaaagttataacaatcatggtaatggcgcttttactgaccgcttgttcaggaggcaacaaaccggcagaatcaacagacaaaacggccgatgagacctccgatacaaagcagtctcaagataagagtactgacaaagaagagaacgttcaaaattcttacactattgatcaggtcacaatcaccgcagaacattattcagtcgaaccatataatgatccgaacggtgaatatacaaaacaaatctctatcatgttcaatattaagaacgaaactgacagtgcctttggctatattaagagctgggaaggcagattacctgacggattcaaattggaaagcctgactgaggcacaagatttagacttaatacaagttccctccggtgactctattgatgacgtagcttatttacttgcggatgattccgcgaatcttgatgagataatagcgacatatttgtttatggactacaacgaagattattggaaagactttggtaaaatcgtgtcgggagagataaatgaagaggaattcaaaagcaaatatggaacgcctaaagaattaacatttgatctgacaccaactaactaaatacaaaccgctccctgatcagcagaccaatccagccttatttagtcaatgattaatccaatgataaaatctgaaccgataaggcaattgaatcctgaagggagcgttttttcatctaaacgggcaaaagccgctatcaagtttaatggaacagaattaacaaatctgtagtgtttttctataatacaaacaaaggaaaagagagggaggaattatttatgaaatgcagcaaatgtggagcagaaattccagaaggagcaaagttttgtactgaatgcggaacaaaaatatccgaggaggccgccgttcatgagaccccgcctgtacaacaggaggcagaacaacttatctataccataaacaaaaataatggaaataatccaaaagtaaatcccccggcaccaaagggcgcggctttcaaaacattccgtttggtattaggaatcatttcaattatattgtttctaatagtctcgctgcaatcatgtgttgcaggagctgcaaatgctttaagctcaaatggtgaagtcagtggatctgcaggatttttattagctatatgtatgttgattgccggaatcgtaacaatatgcttaaagaaaaagcaaacaacagcagcgtatcttgttcctgcaggattttatattgtcggtgcacttctcgcggcagcaaatgtaggaagctactctgatttaggaatatgggccgtgttagcctctatattcggagcactgcatgtattattcatgttcagaagtaagaatactaaggctttaatctctatcattgtccccatagtaatcgtagtcatcatatgcatgttcgtaggaatttcaggatctgggacaaaggatgcagggaataaaaacacaaagaatacggagaataaaacgacaagttcgacagaaaaagaaaatgagaccgctgcaaatgatactgcaaaaacgcctgaaaccaaatcagacagcacagcgaaaccagaacccgatccagatgttccggctgagtataaagctgccttaacgaaagcagcaagttacagcgatatgatgcatatgtctaaagcgggaatatatcaccagcttacttccgaatatggtgagcagtttcccgcagaggctgcgcagtatgccgtagacaatctgaatgctgattggaatgccaacgcattggcaaaggcgaagtcttatagtgataccatgcatatgtcaaaattaggtatctataaccagcttatttcagaaaatggagagcagttcacggcagaagaagctcaatacgccatggataatttgaaggctgactggaatgccaatgcattagcaaaagcaaaagactaccaggaatccatggctatgtctgttgaagctataagggaacagctgacctccgaatacggcgaacagttcacagccgaagaagcagattatgcaatttcaaatttgaattaatatctgcgttaagaacaaatttcagttgaaaagaactcaaaaaagccgcagccccgtcctccgggattgcggctttttattgaatggaaaaatattccctgcgggatgcgcactgcggcataaaaagcagataccgctgtgtgaacgtcgcatgcgcgggtttcgcaaacggaattctattttcatactcctgattcagccgtctaataaagaacagcccgtagcatatatactttagatttcaatattatatcctcttaataattccaataccagctcctcatcattttcagcactattacttttagacatttcatccaggtcaaagcagggcatatgttcccatatatcctcgtatgcaaaatagctgtaaggcgccttccggcattgtatcggtctgtgttcaaatatttcacataaattgttatcagatagaaaaacacattgattattgatattttttagtatatagatatttataacatacccttcacattggatatcatccttttcacaatacttgtggataaactcttttttgcttatgttaagttcatttgatatatgtatcagatcacgtggataaatgattacgattcttttttctaaatccgtacttctacagcacttcccgcatttcctgcaactcatttggtttccccatacttttttacagtttcatcaaccgttttataatttaaaaatattcccctgttccatctgagatctcctctttttaaaaagggtatttttaatttatagacctcatatgccccgaatggatagaatccctgggatttagctctttctgaatttatctcgtagtaggttcctttcatacatatatcatttatatcatgtgaagatattttcaaagtcataacaccattttgtctcaaatctttactatctgaacaatagaataaagaaaccacatccgtagtgaaaacccctcttccccgaaatgtatatctgttctttttatgttctttgtattgtataagtttaaataggacatcttcccggttttgcttaaactgaatgatctcaataatattttctccctgaaaattattatggcgggaataccagagcccgtctatggagaaactcattgcccttttgtaaaaaaagctccgtatctttttatatgtctttccacatataaaacctaatattgaaataattgcagctataacaatctcatcaagtaacttgactatactcccccacatcatattcagcgctcctaagttacaaactatttcttatttttattgttcttttcagtttctttatttttatcggcaatatgtttaatatgttcttttaaagcttttcctccgccatctggcatatgattcacctctcataaaaagatgtggggttaaggctatactaccactcttaccactaataatcaatcgtgttggatcgattatttccatatttttccagatattttttattcttatagcgttataattattacaggggtgcgttatatggatgaaataaaattatccttaaaagaggaaatcgaaaagcaggcacaaataatagaggaagaaatattgcataataaggaaaatgaaaacctggaagttactaaccggatggaaagcgctcttcttaggaaaataaaacagcttgaaagcgaaaaggatacagctggctcatcaaaaaaggctgagatacatacttctttacaggaggatgcctaagaaagaaaccctgaaaatgtctgatccccatattatggtgttcttattgatttaatttccagcaactgctattattaatttatattgatttatattgatcaggtaaacaaagttaagccaaatgcttaacatcattgtggtgtatttctcagtgtgggtattgactaaagaggatactcaggccatgaaacaaaaattatatgatttttcagactacatctcttttgatttggaaaccacagggcgtaactcaaaaacatgtgaaatcattgaaatctcgggaattcttgtccgaaataatgaagtcaaagaggaattcagcagtttagttcatccgggaatccgtatttcgtcagagatagaaaacttaaccggtattaccaataatatgttgtctgctgctccgtcactggataaagttcttcctgaattcattgcttttattggtgataagcctctcattggctataatattgcaagttttgatatgcacatcctgaacaggtttaccgcaaaattattaggaaggtttatcgataattattacatagatctactaacattatccagaaagatgctccctgatttgagcagtcacaaactcggtgcgttagcttcattctgccattgcattgcagaatctgcgcacagagcactgtctgactcccttatggtacacgaatgttttcagtatatgaaagaatatctgccagatactatcatcacccttaagcaattacaatgctccggtgaccgctcaaacgcgagaacatctttggtaaaaaaagaaacccaggcgctccacaaactacatgaatctctcccaagtgtgattgatgttagtgttttaacagaatcctatcatgataaagttgatgctgtagccggaatggctttctgccttaccggagattttttacacggcagcaagtcagaaatcaaggaaatcattgaggatcacagcgggcgatgcatcggatctgtttcgggtaaaacggattatgtaattgtcggcgcctatggcagcgaacaatgggcatgcggtaattatggttcaaaaatcaaaaaagctatggaattgcaggcaaagggatctgatatcagaatttgcagtgagaaggaactgtttgatatgttaagccttctggaaaaggaggagatttctaataattctgctgccgtctcctcttttgaagcagaacttaatcagatgcttttatccattatccaggaaaaagagcttccattgaactctctgcatctgtatgcaaatctatcgaccacatcaaaggaggaaatgtcaaagtccatctgcatatacgagcccgaataccctccggtaaaagatgactgcgtgaatcctggaaagaacttcgtcgtaatgaatattcagatgaatgatgccatagaactgcttataaggaatctgcaatttgaaaatatacctctgccgcataccggaaagctgaaggccgtgccgtcagataagacattccgacatgttatctttgatttttctgatcgaacagtctttgagtatataaaagaaaatgtgctgtactgtttaaaaaactatcattccagagtgagaagcttcggatgctgcagtaaattcatggaatgttctaatgccaaaaagtgtgttcatgtaaataaactttatgcaactgcctgcgcttataagtataatcttgagaatggaaggatattttatggtggaaatagaaatatgtaactaaataagatacttgcgtcagcaggaataggagcatgtgaaaaagtttctgtaaataaggatttatgtggtcttctatgataaaataaaaaatcataggaggccttttattatggcgagagaaaagaaaccggtacacaaagtacaaatgacagatggaaagcgaaacattattcatcagcttctgcaggaatacgatatccagtcagcagaagacattcaggatgccctgaaggatctgcttggcggtaccatcaaagaaatgatggaaacagagatggatgaacacctgggctatggaaagtcagaacgttctgacaatgacgattaccgcaatggctacaaatccaagcgtattaacagcagctatggcagcatggatctccagattcctcaggatcggaagtccactttcgaaccacaggtagtcaaaaaacggcagaaggatatctctgatattgaccaaaagatcatctctatgtatgccaaaggcatgaccacacggcagatttctgatacactggaggatatttacggctttaaggcttcagaaggctttatctccgatgttaccgataagatcatgcctcagattgaggactggcagaaccgtcctctttcagaggtatatccggtgctctacattgatgccatccactactccgtccgtgataatggtgtcatccgcaaacttgcggcttatgtgattctcgggattaatcaggatggacggaaagaagtcctgaccatagaggttggtgaaaatgaaagttccaaatactggctgtctgttttgaatggcctgaaaaaccggggagtaaaagacattttgattatctgtgctgacgggctgaccggtatcaaagaagcaatcgcagctgcatatccaaagacggaatatcagcgctgtatcgtgcaccaggttcgtaatacaatgaaatatgtgtcagacaaagacagaaagccattttgtgcagatcttaagaccatctatcatgcagcaacggaggagaaagcgctagaagccctggaacgtgtcactgaaaaatggagcgaaaaatatcccaattccatgagaagctggaagcagaactgggatgccctttccccgattttcaagttttcagcagtggtcagaaaggtcatttacacgaccaacgccattgagagcttgaatgccacctaccgcaagctaaaccgtcagagaagtgtatttccaagcgatacagctcttttgaaagcgttgtacctgtctacatttgaagctacaaagaaatggtcaatgcctatcagaaactggggtcaggtctatggagagctaagcatcatgtatgaggggcggctaccagaataagtccttttaagcaatctgctacaggcggatttttccgcctgctcttgacatgcaacagcatgtgctgttatatataaaccaagggctgaaagcccaactaagaactttcagcccacctgttatcatagaagatcagcatttacagacttttcttcacacgctcatgcggaaaaaaggaacacttatttatccgcttttgacggtgcaggcatgcttaatcctggttcacataccgtattaggcacgatagttatccgaacatctgataagttaactgcaactcagcagaatgaatttacacagaaaatatctgacaagctgctggaattacagtaattaattatatagcatgatactgttcggcttatcataagaaatgaaaacaaaaaggcaggctcttctcaacagcttccataccaagttttaaaagctgctgaaagaataacctgccttttatactgatccatgcccctcatccgttaaacccaactctcaccgcacaaatctccgctttagtccccactctcatataaggcccgaacacgccgactcccgaagtcactacattatgcgtctgccctttttgcagataaccataagcattttcccacatcagtctgattgtcagattaccgggaaatgtctgcccattatgtgtggatcgttcagctcctctacttttcttccccgtacatatgcaccgtcagctgattatatggtatctcaattccttctctgtcaaaggccagcttaatctcctctagcagccgccatttcgtgggccagaactcatctgtttttacccacgcacgcagacccagaatcaccgcgctgtccgccagagaatccacaaacaccttgatatcctcatcctgcataatcgcgtcatcctttgtcagcagctcttcaagcagcgctttcgcctttttcagatcggcatgataggcaatccctactttcagatccagctgccgctccggcctggcggtaacatttgtcaggctgctgttcgcaagcgtaccgtttggaataacaatcgtcttattatcaacggtggacagctttgtataaaatatctgaatctcctttacggttccctcgtttttccctgtgtcctcaattatataatctcctaccacaaagggcttcagcagcaggatcaacacgcctcccgcaaagttggacaaactgccctgcagcgccaggccgattgcgacaccggcagaagcaatcagtgccgctacagaagatgattccacgcccagctttgtagcaatcgtaaaaatcagcagcgcatataagctgaattttaacagagaatctacaaactggatgacgccctggtcggcgctggtacgctgcagcgaatgtttcacaatcctttgaatccaccggatcaccacacgtcctgccagaaagaatacaaatgccagaaccactcttatcccaaatccgatcagcgccggaagatgttcctggaaatactcagccactcggttcacttcccctgtcacctctgccgccacttcctccgccgattttaaatcagatgccgctaatatcatattcaagcctccttattctgtcgtttccctcagggccagaaaagcacacaggtttccccgcttatctcctgccgttctgtgggaatataagatttcactgttgcagtgtgtacacagatttgtcaccgcaatatgttcctgttttatccccgcctcaagaaagaccagctcatttgccctccacagattcaactgatatctgccgttttctttcctgtaaaataactctccccagaattcctctttataatgcagtttaaactgttcaatcacatcttcgcttacttcataacattcctggcagatcgacggccctaccgccgccagaatatccgaaggattggagccgtactgttcccgcatcaattctacagtcacttttccaatcttggatacagttcctctccatccggagtggcttaagcccaccgccttcttcaccggatccacaaagtacagcggcacgcagtccgcaaaaaacgtaaccaggcataaaccgggaacgtttgtcacaagtccatccacatccgtataacttctctcccgggttatccccattcccctgtctgcttcggtaaccacgcggacatttgcggtatgagtctgctgggtgaataccatgttttcacattttatgcccatagcctccccgatcctcctgaagttttccctcacagattcttctttatcccctctggtaaagctcaaattcaacgaagaatagcacccctcactgacgccccccagtctggttgaaaatccatgtttcactatccccgtattttgaaacaacggatattccaaatatggagtatccgtctctatctcttgaaaaatctttttctgatctttatactgcagtcctaagctcatatactccctttctgtcatccgcaaaaagcatcccggatgtgcgatatcctgcctctttcaatcccgatcacatcaaacctgcacggtatctccgtaaggccgtgcaccatcagataatgggaagcacaccggtaaatcaccctctgcttctttgggcctaccgcctccagagggctgcccttccctgaatcccggcggtatttcacctcacagaagacgagatattccccgtctcttgcaatcagatcaatctctccgatgtggcagcggtaattatattccagaatcacatatccctgctgctccaaatagtatccgaccgccttttcatagttcgtgccggttctcctgttattctgcttttctgcatatttcatattctgtttctactgcgatttcccgttactattcacggcctatgaaccatgcatcgtaatgattccacaccctattgccaacacctgccataccgtctgtatttgcggtatggcatttcatcctgtacccagaaaacaccacaaatcttattcggaaacaaagttttttataaaagatacacgatggattggtgtcggtcccaattttttcaaagcctcgatatgagccgcagagccatatcccttattctctgcgaacccgtaaccgggcagtatcttgtcgtattctgccatcagccggtctctggtcactttggcgataatacttgccgctgcgattgaaacgcttttggcatcccccttgatgatcggtacctggggaagcgtgattcccggtatggtaaccgcgtcattcaagagaagcgtgggagccgttttcagctcctgcaccgctatgcgcatggcttcgtatgtagcctggagtatattgattttatcaatggttgcggggctggccatcccgatcccagtggccaccgctttatcaagaatctcgtcataaagctcttctctctttttcgctgaaagctttttagaatcgttgatatataagatttcacaatccttgggaaggatcactgctcccgctacaaccgggcctgccagaggtcctctgcccacctcgtcaatgccgcagataaatatatgttcctgatacttcttttcatagcatctcatctgctccaggcggaatcgttcttccttcagctttgcttcctgttttttatacctggcaatcagattctgtaccccgctgcgggaatccccctcatatttttcgtatagtaccgataattcacgggactttgcctgttcaaactctaatttaatactgcggatactgttactcatgtttgatcaccccgaacctgtctaatggccaaatgcgaatccaggcccttcccagcagatcttttctgtgcaggactcccacactggcgtcacggctgtccgcactgtggttccggttatctcccagtacaaaatactcatcttcacccaaagtgatcggattctccgcaattcccggatccagcatctcttcgtttccatagtgttcatcaagttcttccccgtcaacatacacacggcctcccatcacctgcacagtctctcccggcagtccgatgatccgttttatatagtatgtatcctcctcatactgataagggaatacgatgatttcatatctctttggttctcgaaagcggaatgagatcttatccacaatcagattatctccgtccgacagcgtcgtctccatagaagagccgctgacacgtgtgcgctgaccaacaaatgtaataatcacataggtcagcccaacaataatcaatatatacacgatccagccaagcagttctcttatgatgcttctttcctggtccatatcttaaccttctttctggcgtctctttctatattatgcataatcctgaggaaattcaagtgttatttttcccagcctgccattgcggaaatcatccatcataagacgggcggctttttccgtgtccagctcgcttccttttaccagacagtgcctgctctctgctatatttctcaggcaggcaaaatcatcctctgattcctcaatctgatatttttccttcagaattccgggataggactgcttcaaaaagccaattaattccatggccagttcctctgtgttgagtatctcatctttaatagatccgataaatgccagccgaagccccacggtctgatcctcaaatttgggccagagtattcccggagtatccagaagctccacatttttattgagcctgatccactgctttccctttgttacgccgggtttattaccggtcttcgtacaggccttccctgcaagcgcattaataaaagtagattttccaacattcggaatccccactaccattgcccggacgggacggttcaatattccccgtttcctgtctctttctatcttctctttgcaggcctcctggattacaccctgtatggacttaatccctccgccttttttggaattcacctttactacggaataaccttttcccttaaaatattccgcccacgcatcattccacttgtcctctgctaaatccgatttgttcagcagtatcagcctggccttgttctttcccagatcatcgatttcgggatttctgctgctcaccggaattctggcgtccaccagctcaatgacaaggtctatcagctttatattttcctgcatcatgcgttttgccttggtcatatgacccgggtaccactgaaaatgcatctgtactcctcctctatctcctgacaaagccaaaatccgggcccggacttgccacgaaccagaccttcccaaagatttcgcttcgttttacattaccgatgtctgccatccggctgtcatcgctgccggcatggttatcgcccatcacaaaatattcatccccgcccagctgcagcggctcatcggcgattcctgcctcctctatatcctctgcaaaaatatgctgtgtcacttcttcctcattaatatagacttttccgtctttaatctgcacggtttcccccggaagccctacaatccttttaatagaataatgagtattttcgtttccgtttggcttaaacgcaacaatatcgccgcgttttggtttgcttgcattataaacaagcctgtttaccagaacaacatctccattctttaaaacaggcttcatggagtcccctgcattgctgacccgctgtccaaaaaaccagacgagcataaaagctatagcgcagactatgataatctgcacgatccagttcgcaatctctcccctgttctgcttctgtgcctgggtcttttctctccggaatctgagttccggcctgccggtgtcaaacttcagctcttgtttctttttccgcctgcgcttctgattcgcctgtctccggcgctttttccgaaagtttaaatcccgcatattcttcccctataaactgtctgcagtaaaaaatcactgaatatcttcatgatatataaaagggacaatatacatgttgtacttgtccctctcatagttactattttactaattcttttaccttcgctctcttaccaacgcggtctctcaagtagttcagtttcgctcttcttactttacctttacgtacaacttctactttttcaacgtttggtgagtgtaacggccaagtcttttcaacgccgattccgttggagttctttcttactgtgaaagtagctcttgtgcttccaccctgtttcttcagaactgttccctcaaaaacctggattctttcacggttaccctctttaatcttggcatatactttaacggtatcacctacattaaactccggtacattctcttttaactgctctgcttcaatacttttaataatatcgttcattgtgtgacctccttaatatttagacgttcttaatgcctgcttacatgttcctatcatcactcctatcacacagcacacacacttccgtgcggatgctctgcaattaaatatccgataccagcaagtctgttattgcatcagaggaccatcgcttttcatttcacaactgttgtattttaccatactttcctataagtttcaagccttttttcgtctctttttcccgttactcgtaacagtttaggcttgcctgaactgttacgcattactcagcctatctaaaggcctttgcccaattataccttcttgcagcagcacatttgaatatcgtttaccatagaagctgcagacattccagatgttacctgtatatttcttctttttttcatggtacgatcatttcgtaatatttttgtaacaattaaacaacattttaggaggtacatattcatgaaacataagatattaccggctctgctcaccgctgcagccataggaacagcaggattcacgccccttacagtacaggcggcatccatagaagaaaccagacaggttcttcagtccaaaggaatctatattgcaggtcctctgaacagcacagaggagctcaaacaaaaacttgaagcactaggatatgactgcaccatcccggactggcttgactgcatcatcccaggactcccgggacagccggagaatccggataacaatcagccggagaacccggaacttccggacggaaaccagccggagaacccggaacttccggacggaaaccagcctggcaccccggagcttccggacaataatcaaccggaaactcccgaacagccggatgttgacgagaacgataacgcatttatccagcaggtcgtaaatctggtaaaccaagaacgcgccaaagccggtctttctcctgtcaaagcagacgtgtctgtacaggcagccgctcagatccgtgcgaaagaaatcgaaacttcattttcacacacacgaccggacggcagttccttcagcactgcattaacacagcagggcgtcacctaccgaggttccggcgagaacattgcctggggacagaaaactcctgagcaggttatgaacggctggatgaacagtgacggacacagagccaatatactcaataagaattacaccacaattggggtagggctctatcagaacgcctccggaactaactactggactcagttgtttacttattaaatcctgattttaggaaagctctgccaatattaaggaatgggatatctgtgaaagcatcataaaatgcacacagatatccctctttacaatccgcccctcttctccagcagatccggccgccgttccctggtcctcaatacagcttgttcccgccgccacttttcaatatttgcatgatgcccggaaagcagcacctccggcacttttttcccatgccattcctccggccttgagtactgcggatattccagcaggttatcctgaaaggattcaaattccgccgacacatcattgtgcagaactcccggaaccagccgtgatatcgcatccaccatgaccatagcgggaagttctcccccggttagcacataatccccgatggagacataatccgtcacaatctcttccagcaccctctcgtcgatcccctcataatgtccgcagagcagcaccagttcatgttcctgcgccagttcctctgccatcttctgatcgaaagtcttaccctgcggtgaaagatagatcaccctgggctgcctctccagcctcccggcgatagattggtacgcctgatacaccggctctgcctgcatcagcatgccggcccctcccccgtaaggataatcatccacgctctggtgtttattaaatgcataatcccggatatttacggcctcaattgacagcaggccgttattcacagcccgccctattatgcttgtattcaacccgtccatcaccatttccgggaataaagtcagtatatgaaaattcatgatattagcccctccagcagatgcaccttcatcgtctgttcctccacattcacatccagtatgcagtcgtgaatcgccggaatcagcacctctccatgttccggtgactctaccacatagacttcgttcgctccggtctcgattacatccttcagcacaccgaactcaccgtcctccgtatacaccttcataccgatcagatccgcgatatagtattcgccctcctccaggctgaccgcatcctcccgggacacaagcagactttttcctttgtatttttctacatcatttatatcatcaattcccttaaactttacaatgacgaactgcttaaaaaactttacgccctgtatctccatgagaatgtgttcttttcccgtatcaagtatcacctgttttaaacttttaaatctagccgcgtcgtctgtcgtcgggaacaccttgacttccccgcggattccatgagtagaggaaatcacccctacctgtaagaactgttccatattcttctcctgtatctgttttcttaatttaacttcacataagacggcatcccgtccagtctccataaaatgagtcagacacccgccattttacagataaaaggaaaggggcagtctctttatgctggcgcatgaaggctgtcccccttaaattctgctattgtataatatcaacaacaactctcttatcttccttggcagcagctgccttcactacagaacggatcgcctttgcaatacggccctgttttccaataaccttgcccatatcgccgtcagcgacacgaacttctaacacagtagtcctgccgtcctgtctttcagtcacaacaacgctgtccggttcgtctactaatgctttcgcaattacttcaactaattctttcatctaagccacctccgcggaacagcttatttctcaatgcctgctgctttcaagatttttcctactacttctgtaggctgagctccgttgtttaaccacttcttagctgcttcctcgtctaccttgattccgcttggctccaggttcggatcatatgttccgatttcctcgatgaacttaccatctcttggagatctggaatctgcaactacgattctatagaaaggagccttcttctgtcccattctttttaatctgatttttactgccatttttttcacctcttcttattattttttcttttttgttaatttatgtgttaaaaaggaagcctaaacttgcctttcttaccacctttgccgcccatcatgcccggaagtttcttcatcatcttccttgcctcattgaactgcttcaccatacggttcacttctgatatattcacgccggcgcctctggctattcggtgctttctggatggatttaacagatccgggttgctgcgttcctccagtgtcatggaatggatcatagcctccatccgggccattttcttgtcattttcctcggaatccaaatccggcagcttcgagttcatgccgccgagtcccggcatcatgctcatgacgcttgacagaccgcccatctttttcatctggctcatgctttccagataatcatcaaaatcaaactgggccttcttcatcttctctgtcatctttttggctttttcttcgtctatctccgcccctgctttttcaatcagagtcaggacatcccccatacccaaaatacgggaagccattcggtccggataaaactgttccaggtcggaaagtttttctcccatacctacatataaaatcggccttccggttacggctttgattgacagcgccgcaccgccccgggtgtcaccgtccagcttcgtaacaatgactccgtcaattccgatcttttcatgaaaacttccggcaacattcaccgcatcctgtccggtcattgcatccacgaccaggatcgtctgatgcactgtgactgtctccttaatctcctgaagctcccccatcatatcttcatcaatgtgaagacgtccggcggtatccagtatcacaatgttgttgccattctttaccgcgtgttcataagcggcctttgcaatgtccgcaggcttgttcttatcccccatggaaaatacttccacaccctgcttctctccatttatctgtaactgcttgattgctgccggcctatatacatcgcatgccacaagcagcggtttcttgccctttaacttgtactttccggccagcttagctgtagtcgtcgtcttaccggctccctgaaggcccgccatcataatcaccgtgatcgcactgcccggctgcagctgtatctccgtcgtctcggatcccatcagcttgaccatctcttcgtttacgatcttaataaccatctggcccggattcagtccgttcatcacgtcctgcccgaccgcgcgttcctgtacatctttgacaaatcccttaactaccttaaaattgacgtctgcttccagaagcgccatctttacttccttcagggccgtcttcacatcgtcttccgtaagccgtcccttactgcggaggtttttaaatacgttttgaagcttttcagttaaactgtcaaatgccattctataactcctctataatagtatccgaaattctccggattctctcagccattacttccggctccacatctcgactctcgtaagagtcaagcacatcattaatctcctgcaccatcttttttacagaaagaaacttctcaacaagatgcagcttgctctcgtacccttccagaatcttctggcagcgcctgaccaggtcgtggacaccctgtctgctgatcccttcagactgcgcaatctcgcttaatgacaaatcttccagcacaaactgcccataaatctctttttggtgatccgtgagtagttcaccataaaaatcatataacaacgcctgttccaaaatctcattcacaatcatcacctttgttatcatactaaaaagcagggcgggtgtcaagtattttttcttgacacctgccttatttttttatccgcttttaaacttgtttttccaaactgtattccagcaaattacatcgtaagcagttttcctacgttgagcatcccccagccctgtgccgagcactcatttctgacacaggactcacgtagcttaagctttacctccacattggtcatatccggaaattttgacagcatgcaggcgatcgctcccgacaccacaggcgttgccatcgaggtgccgctttttgtgacatatggcttctgccagcggttggtataatctccgttacagctcaggatattcgtcccaggcgccagcaaatccggcttaataacgcaagcatccgtagggccgttccccgaataattccattctctgccgccgcgccccgcaacgatcgatcttttctcccccactgcccctacggttatcactttcctgctggtacccggaacggcgactgtccccgcgcccggtccataatttcctgctgagacgaccaccacaagcccttcatcccaaagcgcttccacagcatccacaagtctttgttcctgtgctctctccactcccggctgtgttcccacagagatattcacaatgcggagtttcacccttttgtggatcataagcagccagtcaattccctcaagaacatcctccaccgagccgttccccgtatgatccagtacctttcctaccagaatctccgcccgcggtgccatcccggcgtatacccccgaggacagcctcccgctcccggcaaggattccagaaacatgcgttccgtgcttaccatcatcatatattttatctttatgattaacaaaatcgcgaaaaccaataattcttctatcaaaatcagggtgaagcgtgattccggtatccagtaccgctgcgcgcacaccctgtcccaggtacttattagtaatgatatccgggcaccaatatccaacagtctgctttacccatttcatgaaaacaccttttttaatatgatattcagaaatgttgtccctgtctactaattccacgccccgtctgttaactaacctcagtcttctcatctacccgcagcatccggtaccctacgcctatatgagtctggatatactgcggattggatttatctttttcaatttttttgcggagtgacgccatatacactctgagagaggacatatcgctttcaatcgcattcacccagactttatccagaataaactggtatgtcagcacttttccaacattctgcgcgagcagacagagcaggctgtactccaaaggcatgagatgaatctctttttctcccacaaagacagttcctgcgccgtaatcaatcaccagatccccatctttaaacacactggagttctgatccttcgtccgcatgagatactgcaccctgcgcagcgtggaacgcagtcttgccagcagctcctccacactgaacggttttgtcagataatcatcagccccggcgtccagagcttccactttatccctgtcatcacttcttgcgctgatcacgatcaccggcgcaacagaccacgtccggatctttcggatcacctcgataccgtccatatccggcagccccaggtccatcagtatgatatccggattgccggaagccgcagccatgaccgcctggtttccgttagcagcagtctcatatttataatcctgggattccagcgttgtggtgatcagatttctgaccggcatatcatcctcgacaacaagaataaaaggtttgccattcactgtcataatgttacttcctccacttccaattcaaaacaaaatacggttcccttcggaacattgtcaaatacttttaactcgcttccatgagcattgataatggatttgcacaaagtcagccctaggcccatcccccgcctgccgtcggtaaccgcatggcctgcggtataaaacatctggaacagcttgggcttgagctctgccggaatccccggtccattatctgctaccgagatcacggccttatttccctgttttagcgctttaatccagatctcggagcctgccggcgtatattttaccgcattgtccgtcagattaatcaacacctgaagcattaattttacatccatcttcgccatcagcagctcatcacattccacgtggatcttctgttcttttccgcgccggttcacgtgatgcagcgcttcttcgatcacatcttccacaatctcgccctgaaggttcagttccatcgtgccattctcaatcctggtgacagaaagcagattttcaaccaaattaatcagccacatggaatcatcatagatatctttgtaaatcttctttctctgctccttttccacttcgccttcattgatcaaaagggtctcggcattgcccgatatactggtaagaggcgtccgcagatcgtgggaaatagagcgcagcagattcgcacgcagctgttccttctgcagcttcaggtcaatctcctgctgttgtacgaggagtgcctccttctccaacgcaaacgcgcactcgttcaaaattgcccccataacgccttcttcaaaagctggtatcggcttcttctccatatcaatctcgaccaccgcaaaaactctctccccgctcctgaccgcggcaaaaaggaagcgggaacccggaagcgtctgggtggaaaagcctgcatgtttattgttgcggaaggtccactgggcaactcccaattcctcctcccccagcacatccggcgcatccggatctttcttatatacaatcggcctgtttttcgccgatggtttcccgagatagaaataaatattcttctccagaagcattcccagctgctgaatcgttcttgaagcaatctcctgggtggtacccgcatcctgcagctttctgctggtttccaaaagcagttccgtacggtaggccttcctggcattctggcgggcatagttcttcacctgcttggtaagcgccgagctgcacagggaagtgacaaacatcacaaaaaatgtaataaagtatcccggatcattgacagacagcgtccgcaccggatccgtaaaaaaataattaaacacaagcacgctgaaaacacttgtaattataccccagatctgatggctggtaaacatagccgatgtcagcacacccaggatatataccatgaccagattggcgtcgctgaatccgagcctggtgaagatcagggcaattgccgtggacacgcccaggctgacaatacatatgagcgcatcaagccaggccttcttatatgtctcttcccgcctcttttttacgcggcctctgtacctcttatcgaatgcatccgggatcagaaagatttccaggttcggcgccagcctggatagctgttcggatacgctgtcccggataaacaaaagccttcgttttgtataagttctgcccagaacaaccttggagactcgggatgcctgcgcatacgccgcaatttcttctacgatatcatttccataggaagttacgatttttgctcccagctgttccgccagccgcgtattatcattcagccccttctgatccgccttcgacatattggccgaatcgggcgtttccacatagagcgcagtcagtttgccgtgaaatgcattcgccatccgggccgcctgccggatcaccttgccgttggaaggcgaaggggacaagcataccataagatgttccgctgtctcattgctggcatggatcatgctgtcctgggcaagattcacacggtcagccatacgccgcagtgcaatttcccgcagagagatcaggttatcctttgtaaaaaagttggaaagtgcccggtccgcctgcttttccttatagatcttcccggccttcagccgctccagcagctcctccggctcaatatccaccatctccacctgatccgcctcgtcaaacacgctgtcgggaatccgttcccgcacaagcacccccgtaatccctgcaatggtgtcgttcagactctccaagtgctgtacattgaccgtagtataaacattaatccccgccttcaaaagctcctttatatcctggtaacgtttggcatggatactgccctgtgcgtttgtatgcgccagttcatccaccagaatcagttcgggttttctgagcagcgcagcctccaggtcaaattcatggagacgtatgccgtgatattccacctcttttacagaaagcatctccagaccctgcgtcagagccatcgtctccggcctagtatgcggttctatgtagcctgccaccacgtcaattcctgcgtctttcgccttgtgggcagacgacagcatggcataggtttttcctatgcctgccgcgtaaccaaaaaatatttttaatctgccttttccgctttgttctttctcagcctccatcagctgtttcaaaaacagatccggctttctgctgtcttccttcatcctatcaattcctttgccgtttcctttctgctatcttacttcagaatcttctgcattgcaagatgaaaccctttcagacattaggatacatcgctgtccgggttattcttagaacaagtgggcaagcccacctcaactctccgccccctcactcatgaggggcttgcacactttggcgccgccgcaatgccgctttgcggctatataccttatggcggcgtgtgcatcccccgaagggttttatataataggaaagtgctaagtactttcctatataaaataacacatacaccataaaataggtgtgaaagaaccccggccggatattaaaatggtataaaaatctttttaaaaataattagggaaatcttttcacacatttgtaaccacctacatattatgaactgtaatcaaacatatatggaggatttaacatgagtgatttaagtgctacaaactgcggatgtggatgcgaaactagctgcggaggatgcggaaacggaatgtcttcttgtctgtggatcattatcctgctttgctgctgcggcggcaacggctttggcggcggatgcggcaatggctgcggcggcaacgacagctgcctgtggatcatcatcctgctttgctgctgcggcggctttggcggcggaaacaactgcggatgctaattccaaaccagtaaaacttaccagaacaggaatttctgcccgggccatcccgtaacatttacgtttcgggcgcccaaaggcaggaaataaaaacagccccggtacagatctttgtaccggggttattttatgatataggaaattcattcagaatttcctatatcataaaaccctatgggagaatgcacacgccgcaataaagtatatagccgccaaacggcatcgcggcggcgccagcttgcccactttgttctagcattctaaaaatggatttacccgcatggttatggttttgccttattctgatcctgcggcctttttttcccctccggctctttgttccctttcttctcttccattcgtttcttcagcatgcaatcctcgtctatctcatacaccgcatttccatcgataatcagttttcttttcattttgaaaccgccctttcctttctattccctattatagtatgtaggagtcctcactttagtcttatcccatcctcatatttttatacttctcatcatatatatttacaacgtgataaacaggagtgaatatggaaaagaaaacgccaaaaccaatgacaccgtttgatgaactggttacaccgccccagcttcagatgctgaagctgtttctgccctacactcctgcttctaaccagcagtttttgggaatattcataaaattccaggagctccagcagacaatttctttttttcagaatttcgaaaacgatttacatagccaggcctttggcagcgaccaggcaccatcgatgatggagatgctccaggagttaaggccctatctgccgcagcagcaggcggaaatgatggacacatttctgaatatgatgaatataatggaaatggtacaaatgttccaggaaagctctcagggccaggaaaatggtttttcaggcacagacagcggtttttcatccgaaaacagttttgccggagcctccggcggcggaactgaccacatgggcggcatgggaaatatgttttccggaggcttcaatcccatggatatgatgatggggatgctgactcctgaccagcagaatatgttccagatgtacaatagcatgttttccggggatacgtcctttgacccaggtacaggggaggattctgctcatgcggaagccccaaaagaaacctcctctatggaagataccacagaagacatctcccatggaaatgaaccatgggcccctgcttcggcggaaaatgcaccaacccaaactgatacagcagacaatgcccctatggggaatgattcatttatggaaggagatgatatagatgaacgaatggatgaacaatccggctatgaaaaatattgaccccataaaactggaactgattcaaatggctgcttcccagaccgccggcaaatccggcagagacctggcccccatcatgatggccctgatcacaaatgcaaacaaaaagggtatcagtttttccggggacgagatgtcactgatcctggaaataatgaaagatggaaagtccaaagatgagcaggcgcagatcgacagaaccatcaatatggtcagctcttttatgaagaaaaaatgatcccccaataacccggaggataaaaaggaaagaagaaggcctaaaaaccttcttctttcctttttatcctcatctctcttctcttttttgctgcttcccattctgccttttcttcctcactctccagaatcaggcgcggcacccgcttaggcttgtcattctcgtccaacgcaaccatcgtaaaataggcacggttaatcggcctgcgcatcccgtccatattttccacataagtatcaaccctgacttccatggacgtattacccacataagtcgccttcccgataatcacaatcacatccttctgataagccccctgaataaaacgcaaattatccaccgaggccgtaataatgttgctcctggtatggcgcttcgccaccagcccggccacatcatccagccactgcatcagaatcccgccaaacaaacgccccgccgcattcaaatgattcggccgtaccatatgcaccgtttccaccctggaatccgcaactcttctctcttctatcatctaacccaactccaatccgcattcctgcgctatatttttataaccctccagcgtctccccctcttcacaaaacaaaggatattccagaccataatttccccagaccaccgctttttgcttcgtaaaataaaaagtagaaaacagccagttcctggcagtaatctccgcaagaaaaaccagattttccgccaccaaaggatagtatacctgcctgggttccgtttcaaactgcaaaaatacacttttttcctcatcactcaacccagccacaaatccacgctgttcctcctcagtcagcaccgaataataaaaatccgcaaaagaagcgccctcattcaccaccagacaccgctccaaaaagcactgcatcgccagcttatcccctctaagagtcacagcctcaaaccgcaaaaaaccatcctgaacattctcaatcaaaagcgccccccgcgccgccagttccccttcactcaaagaccgaaacataatctcctcctataaatacccctccaccttctccaaaaacatccctttcggatcacaaggtgcgctcgcctcttccgcccccgaaaagactgcctcaatacattccaccttccgtttcccaagcccgatatcaagcaaggttccaacaatcatcctcggcatattatgcaaaaaatcatttgcccgaatacgaatctgaatctcttccgcatcaccatggatgtctatattataaatctctttttccgtagacttactcttcttaacagttgaaaaatgtttaaaatcgtgtcttccggccaataaaagagccgcctgctgcataacacccacatccggggtgcggaacgcataataagtatatttccggttaaatacactgggcaccgcgccaatagcaatccgatacagataactcctggacttcgcattcagtgaagcatgaaaacgctccggcatctcctccgcagaaagaaccgcaatatccataggcagataacggttcagatactgccgtatttcatccgctttcatatccgaagtagtcttaaaattaaccacctgcccataagcgtgaaccccaacctcagtcctggccccacaaaacagttccacatcctccgcggtcattttatgaatcacatccagcagcctgttcgccaccgtatttgccgactcccccttaccaagcctctgccatccctgatagcgcgccccgtcatactccaaaactaacttaatattatgcattcttatcactcctccatattgtcgaattccgcgaaactcacacttgcagcggccgcatcatgccagctactttttctgcctcattcccgtccagttcaatatcccaatctcaatacctactcctatcagaattccaacggtataacacactaaatcactccataaaaaaccatattccaaaatcaatcctcccagtgtagtgtggcgcaatacatttatccaatctgcttgatacaattgggaaaactctattgcaaaagagaacaccaatgccgccagcatcacttttgcagcagccattttagaaaataggaatccaattccccaaaataccatcatagcccacaaggcatcacccgcatagttcctcagaaataccggcagacagtcaccaaattgccttgacgcaagccctaataccattgtaattacaattaaagcaaaataaataattctactccttttcataaatactccttttatataggctggcctgcacgctccctttattgatgttgccaattacagctataggcggcagacatcctttttacaaaagtacctctgccacttaaactcctcagaagaatatccccgctatgtgataggccaggaaacttacacaccacgccactgccagctggaataacacgatcccgactgtgatctttttactccccacctcccggttaatcgtagcgattgtagccgtacaaggtacatagagcagacagaataccattaatgcataggcgttggccgctccgaagcccatagcccccagtgttcccacaaagcttgccattccatggcccgtggtaatattctggataccaaacagtacactgcagctggataccacgacttcctttgcggcaatccccgcaatcagggctacaatgatctgccagtagccaagacccagcggtttaaatattggcacaatagcctttccgatcatagatccaaaactctgggaaatgtctgtcacatatccagcagttccaaaattcaggatgatccacataataatcgaagctataaaaataacggttcccgccttggtaagataatctttcaccttttcccagacatagatcgcaattgtcctcgcgttcggggtcttatactccggaagctcaattaaaagggaatgttccgccttacttccgtcgattttcgaaaggacaaaggccgttgtgatcgcaacaataattcccagcagatacatggaataacaggccatcatcgcatgttttccgaaaaacatggaagaaaacagcacatagatcggcagccttgcgctgcaggacataaaaggcgttaccatgattgttttcagcctgtcctttctattttccagtgccctggatgccataatcgccggaacggagcatccgaatccaagcagcataggcaggaatgccctcccggaaagccccaggtgccccatgatatcgtccatgacaaacgccactctcgccatgtacccgctatcctccaaaaaggcaagcgccaggaacaggataaagatattcggcagaaatgtcagaatccctccgacgcctgagataattccatccacgatcagagactgcagcatggcgttcacattccaggcggtaaacaggctgcctgctgctccggatatccactcaagcgcgatctcaaagtatcccttcagccagtcccccacggtaaaagtcaggaagaagacaagagccatgattccaagaaagataggcagccccagccatttgctggtcatgaaacggtctgctctgtccgtccgttcctctttcttactcttattcaccagggtctcctgaataatctcttctataaaatcatatttctggttaatgatatccttctcataactacggtccataacctccggcatattcacggggtatttctccataactgcatggtcctgttccagcatctttatggcatgccatcttttattttccatccttggatacaaacgcaggaactgttctataatcagatcgatcttatcttctatctcatcctgataaaccattgcgtaatcgcggtgatgattatgtatatgttttgtgttctcagcatggtgatggataaaaggactctgtcttgcataatccttgtggtgtgccaccgcatgcatcaggatctccagcccgctcatctttctggcggaaaccggtattgccgggatgcccagcatctccggcagacggtgcaggtcaatctccatgccgcgttcttccacgatatccatcatatttagtgccagtaccactggctttcccagctcaatgagctgcagcgtcagatagagattgcgctccagacaggaggcgtcaaccacatccacaatgacatccacctctccgctcataatgcattctctggataccttttcctccattgtatacgaggtcagactgtaaatacccggaagatcaatcagtttgaactcctggtccttgtaaaatgcctttccttcttttttttctaccgtaactcccggccagttcgccaccttcaggttggcgcctgtgtatgcattaaataacgttgtcttcccgcagttcggatttcctataaatccaacattaattacccgatcgctcatgcccggacctcctcaaccacaatgttgtctgcgatccgttttcccaaagcaaatcttgtgccccggaaccttaccgtaatcgcgccctttttatcattattcaatattgtgatattagaccccgtagtaagtccaagcgcctccagcctgcgctccagattcaattctgtattgatctcctgtacctggtaagtatgatggtttctgccttcttttaacctcatggctttctcctgtaaaatgtatttggtattgataattattctccataaggaattataaatcttttcacacagtaagtcaaatagattgacattttttgtcacaagatttactctataaataatagctttccgatttctgcgattctgatatgcgggattcatatgagatgcagaacatcaaaatataaaataactgccactaaagagggatatgattatggacatttattacatattactttacttttttgtatacggatttttaggctggtgctctgaggtgggatttgccgctttcaaggagcacagatttgtgaacagaggattcttgaacggccctatctgccctatctatggtgtgggagtcactatagttatcgcatttctcacaccctacaaggacaacctgattattctctatgtttcttccgtcattctggttacccttctcgaaggcattactggatgggcaatggacaagatattccacaataaatggtgggactattcggaacagccttttaatatcggcggttatgtatgcctgattttctctctggtctggggaatcgcctgcgtggccatcatggattttatccacccgctgatccataaactgctgacttttcttccccatacggcagggattatactgattgtgttgctgggaattgctatgtttgcggatctctatgtcactgcaaccgcaatattcaaatttaacaaacgtctggccagcatggaaaaaattgcgggagaactgcacgagatttccaatcaaatcggtgaagatatctatgaaaaagtaatcttcgccatggaaaagcaggaggtttccaagcagaaactggacgaggccgcttctgaactaagggaaaacatacaggaggccgcctccggactgaaagaaagaacacaggaagccacttccggattgctgggtaagacacaggaggccacctccggcttacgcgaaaagacgcaggaagccgccgcagatctgaaggaaaagacccaggaagcctccgaagaaatgcgcagccgcattgcagaacttaaaaaccactaccaggaacttggcagtaaaacaccgcgtgtcagccgccgtcttgtaaaagcatttcctaagatggagtccagaagcagtaaacatcaactggaagaattgcgaaaaaagtttaatcttaaaaagaaaaaataacctgctgtgaaaaataattcataacatggaaatggcgctgccatagggaagggattatatttatggagaataattgggagttttttgaaaatctgcaggaactcatttttgtgatagatatggaaaaccacacaatggcctacatgaatcataatgccaggaatgcctttggctgccccgatcacgaggaataccagaacagagaatgctatgaacttcttcagggcctttcgacaccatgcccgttttgtacggattccgttctagcaatgggcaggttccatgactgggaatacaccaatcctctgactcatataacttatatattaagagatacaatgttcgaactgaacgaaaaaatatacagaattgagctcgcctatgataaaaacagcagggatatggaagaaagtgaaagtcaaagctttactcctgacacaaaaaagttttgggatgacaatataaccacactttctgatggcagcacagcttttcagacctttatccgtaataattattttgacgcggaagcctttttccgatctgttgccatacctgacgcgccttattacctgtatttcggcgatttacagagcaacctgtattacatatcagataatatgaaagatgatttcggattcctggacaacattgtttacaatctgattgatgcatggggtgagaaaatcagcaatgagcaggaccgtattttatatcacgaagatcttcggcacatcatggagcagaaaaaaggggtgcacagcctccgctaccggattacagacaaaaacggcatttctacatgggtacactgccgcggtattgtaaaatggtcaggagataaagatacgcccctctttttttccggctgtgtctcaaggctggacagcgacttctccctggatgctgtcaccggttttctgcgtgagcagtctgcactgaatgacctggcggcacgcatcggcataatggatagcactctgatcgtgggctttggcctcaaccattttacctacatcaacgactccaaagggcgagcaaccggcgatatgctgctgcgtgcaatttcaaactgcctgctggagaaactgggaagtctcttcaccttctaccggctggatgggatccgctttatggctgtttcaaaacagaatgtgtcatatgacgaaaatgaagccgtcgaaaacatcaggctcaccattgaggagtgttattccaaacagaagctgtccacaaagcaggcggcctccttcgggattctgcatttcccggataacggcgacactccgcaggaaattcttgaaaatacaatgacattgatcagcattgctaaacttaatcctgatctgaaatacagtaaattttcttccgatgtgatagcaaaacagaaagataagtccatcatggccctaagcctgagtgaaaatgtagaaaaaggctgcgagggcttccggatcgtggtacagcccatagtctcccgcgataccggaaagatcattggaggagagacactgcttcgctggcgctatcacggacaggaaatatctcctgtggtatttatccccttgctggaggagacacgcatgatacttcccgtggggaaatgggtttttgagcaggttgtctcgctctgcaaacagatcctggtctaccagcctgattttcttttatcctttaacgttagctatctgcagatactggatgatacgtttctgcctttcatccggcagaccattgaggagagcgggcttttgcaagggcatctgatgctggaactgacagaaacccatttcgatgagatgcctattcggctgcaggaattcgtcgccgaatgcctgaaaatgggaatcaaattcgcattagatgactttgggaatggattttcttctctgcagatgctttttaaatatccggtaaatgtcatcaagctggatcgtacattgatgaatgagatcacgcattcttcggagaaccttgattttataatgagtattgtctacgcctgccaccggtcgaagaaacaggtctgtgtggagggtgtggagacagatgcggaactggagattgttcggcagacggactgcgatatgatacaggggttttacttttatcggcctttagaggttgcggatcttttaaggatgcttgaagagggagggaaaatatcgggtgaggggcgctgagaaaaaggggagtccggcttctgcagggaatgcccgtgccgttgtaatatccggccgcttgctgagaatcagtaacagacaaaatatggggaatagaggtacttgccgcagttggcgtgaatgccgatgcattcacaccgccggcggcaacaggatttgattttgtgaatcaaatcctgccctctattccccatattttctctataactgattctatgcgcgctcttaggattttacaacggcacaggcatcccctgcagaagccggactcccctttctctcagctggacgcatcagggcgggaggattttctcgtccctttgggactcgcgggtctcctgtttttctttttctgcctgctcttctttgtcgaatttgtcccaaagtaattgatagattatcatgataatcattatgatacctagttctattaatgcaaatggactttttaggaataggacgatcctgccgacataggggatgtgaaaaacataggtgcctatgatgtcctggcgatgggttatataatcgtctggccgttcggccgttgctccctgggtcagatatcgggtagaaccgtcttcctcggtttctgttccacggtaatagtgagtgaagacggcatcctcacccagacggtctacacggaaggaaacgatgtctccttctttaggctcttcgtcatcttttaggtttttaacaagcacagcagagccagtcggtaagactggctccatgctgtctgttagaattacaaatgtttggtatcctaaaaatttatttatcttttccggacaaattttcattaagactatatatgcaacaagcataattagtaaaacattcggcaatatctttaatatttttttcatataccaatttatggcgtagtagctttagacaactctccgcttagaacaactgtatattcacctgacgtagccgcatctgtaggagtaacttcaacagtatagtcctttcctgtcgcagccgctgtctcatcattaaatgtagattctgtcacaattgaatttccatctttgattactgcttcaacatcattaaccggcgttccagtggtatccgttcccttatacacagtcgctgtaagggctaatgttgttttcgtgccagttggtacgcctgttgccttaatattaatcggggcgcttttatatacaggtgccgttccccattcagtatctgtctccgtatacgtaaccggatcagtaggtgccgccacttctatcttatttcttagtgttactgttcctgatgcagaatcactcaactgatcccacaccgcataagaccccgccatagttaccacgattgctcctgctgttaagaaccccagcattttctttttacttaattgccatttcttcataccaaattccctcctaaggtttgctacaatttttaactgacttcagtatatactggaacaggaggtttggctaatgcttatatcttattatcccgtgatacgtattgattatcacggcaagggtttttagtcggcgtagcagtccatgaagagtttcaaaaagtcctcggcctgcggggacagtatctctcttttgcgctttatccagattaatttctggtatacatcacagtgattcagtaacaggctgttgatctggcctctttttaactcttctacctgccatttgttcccaaatataaaggattcggttctttttaccatgttgatgattgcatggtagttattcatttggattgtcttatcaaaatcgctgacttggagcttaccgtctattgtcatgctgttgtttatattggcgaagaagtcgagcggaagcctgacacggctgtatggcagcagttcttcagcatctatggcagtcctctcataaaatggattctttttccctaactggacatacaggggaccctcgccgatctcatgcatttccagctcttttagttcggtcagcttgtggaaagcggctctctgcatgttgttgattgtcacgattccaatgtcagccttggtctgctcaacctggttcaatacatcttcgatcgtcgtctctatgatatgaataccggttcgtctggcgcgaattgtctcgtaatactggtagatcatgtcatcccgcataatcaatttgccgattgcgatacttattctcgattctatgtatttttcagtattcatcttaatcttagaaatctcatcgacttgctttaggattgatttggcataataatagaacccctcgccgaatgtagtcatctccacacccttatttgttctgttcaaaagcgctgacccgaattcatgctccagattatgtatcgcccgggtcaggttcggctgcgagacatacaggctggctgcagccttacgcatactcttctgctccgctatctccacaaagtattttaaatcttttatctccatttgttccgccctcaaaattgtactcttttcaagaattatacctcatttgcgcatacaatgatagcagaagagcctgaaaaacttttccagtttttgtgttttcccctcttccatggtaaaataatattaagaataaaaatcttttatctaagcaaacccggatacgggaaggaggaacccttatgttgccacagatacttgtacagcttgaatatcttgccagaattttaggtgcggctctttgcggtatggtcgtgggatatgagcgggaaaatcattttaaaaccgccggaatccgtacccatacaatcgtagccctcgcttccgccgtcatgatgattatctccaaatatggtttcaatgatatactgccgctgaatcacatcggtcttgacccctcccgtgtggcagcaggcattgtaactgccatcggatttctcggcgcaggcattatcttcacccgcaatgtaaccgtcagcggtctcacaactgccgccggtatctgggcaaccgtaggaatcgggatggctttcggggctggaatgtatgtgctcggagtaatgacgaccatctgcattattataatccagttcatcctgcacaaaaatttccgctggctcaaaacactttcaatccagcagatcaccctcgagatccgggaaacagatcatctcaaaagcatcctgaaagattccttcgccatcagagaccttaagattctaacgatgaaagcaacccgaatagacgaagagacattgaaactaaaactgaacgtggcattcccggacgattatacattccaggatgtcatagacctgctcaaagaaaacccacaaatcaaatccgtagacatctagtggggggaacgaatgtggttttgttacttttgcggatgggggacacgtatgaggaggggagtccggcgcctggcggggcaatgtctgctggtgaaatgtcctgacacttcgcgaagaagctgtagaagaaaacggaaggggaagagaggtacctgccgcatttggcccgaatgccgatgcattcgcgccgcaggcggcatcagaatttgcctggtaaggcaaattctgccctctcttccccttccgttttcttcaacagcttctaacgcttgctttatggacttttcaccagcagacattgccccggcaggcgtccctcacaccaatcccctggtagactcccgaaccagcaattctcccggaagcacaacctttttatgctgcccgttcttccgtattatgttaaacagcaggtcgattgtaaccttcgccatcttctctaccggctgacggatggtcgtcagggccggagtatagtatgtcccgatctccagaccgtcaaatcccgccactgaacagtcctgcggaatctggataccggcctctgtgagtgcacggcatgccccgattgcaagactgtcagcaatcgcatataccgctgtgaactcctgcttttccgccagcagagacttcatgagacggtaaccggtcttcatggaatagctgtctgtcacgtagtccatatggcagatcagcgcttcatccggctgtatatgattgtcttccagcgccttcagatatccctcgaacctgagtttaccaatactttcatcctctttatccgcagatataattgcaatccttttgtgtcctgccctgcacagataatctgtcatcttatagctctcggcataatcatccaccgagacggaagaccagagcggtccctcctccgactcttcattgacgatccctgaggtactcaggacaaacgggacatccagctgtgcaagatgctcactggagtgcgtaataaagccgcccaggaagataattccctttaattttttttctttgaccagctcaatcgccgcatccagttcgttctcgtgttcctccaccctctgcaggataaacgtatacttcttccgctgagtttcctgttcgataattcctatcatgtcattgaagaagggattcgttatccctttgaccagaactgctatggctttggcatcggaacgtttcaggttccttgcactgttgttagggatgtaattatgctccttaatcacccgcataaccatctctttcgtctccggattgatatccggatgattgttgattgcacgggatacggtgctgactcctaccccgcatatcctggctatatccttaattgtctccatgctgatccctgcccttattcagtattttggacatacacgctccgccgggccgattttatttttaatagaagtttctcttcggtatgctgtcctttacgagatagaaggccgtaacagttcagacatgtctaaactgttacagacgaccgtatagtttcgttatcttacgtatctcttctataagagtatcatttaactcaccttttttcaaccgccatacccaattatttcccagtgtcgaaggcgtattgatcctagcctcactatctctgcagagataatcctgaaccggaatcacacacagctgtgccacactgctcatggccatagcgataaagtcccatgccagctcatcttcatccagcgcatgcctatgcagatattcttttgcaaaatcacggcactccttatccacatgatgataccagccccgtgttgtatcgttgtcgtgggtcccggtatataccacgcagtttggggtatatgtgtgaggcagatagttcgccgattctctggaatcaaatgcaaactgtatgactttcatccccggaaaaccagtgtcttccaaaagcttcaagacactgtctgttaaaaaccccagatcctccgcaataatattcagcctgccgagcttctcctccactgccctgaaaaattcgattcccggcccgggcatccatttgccgttcacggcggtcttctcaccgtaaggaatcgcatagtattcgtcaaatccccggaaatgatcgatacggacgatatcatacagccggaagcagtgggcgattctccgcatccaccatgcatagccggtctttctatgatattcccagtcatacagcggatttccccacagctgccctgtggcggagaatccatccggcggacagcctgcgaccgcggccggttccttattctcatcaaactggaacagctccggagccgcccaggtatcagcactgtcaaacgccacatagatcggaatatcgccgatgatctctatgcccttttcattggcataggcatgcagccgtttccactgcctgttgaattcgaactgctggaaacggtagaaatcaatctcttctgccagtttccctctggcctcctccagggctttctcatctctgtccctgtaaggagcttcccattcccgccagctgacgccgccatgctggtttttcagggccataaacaaacagtattcgtccagccattccctgttatcctccaggaatttacggtattcctcattccggctgccgtcaaacctgcggtacgcctgcctcagaattttaaatctacccagatacagcttttcataatctatacagtccttcgttttcccaaaatcatatgatttacattcttcctctgtcagaagtccttcccggattaaagtctccaaatctatgaaatacggatttccggcaaatgtagagaaagactggtacggggaatccccatatccggtcggtcccagcggaagaatctgccatttactctgtcccgccttttttaactgatccacaaactcataggcttcttttgaaaaacatccaatcccatactcggaaggcaatgcgaaaacgggtaataaaattccactttctctcatcgcgtttcccctttctgttatcctttcactgcccctgcagccacacctttaataatatatttctggcagagcaggtagaatacgatgatcggcaggattgccagaaccagcatacccatcatggctcccatatccaccgaaccatatccgcccctgagatactgcactgcaatcgggatcgtctgataatcgcttcccaatacaagcagggggagcagataatcgttccatatccacatcgcattcagaattgcaacggtaattgctgtcggctttagtaccggcagcacaatcctgaaaaatgtctggatcggcgtgcagccgtcaatcatggcagcttcctccagagaaatcggtatcgccttgataaaacctgcaaacataaacaccgataatcccgctccaaaccctacatatacaaagatgatccccaccggatttcccagatttaacgtatctgtcaccttggacagcgtaaacatcaccatctggaacggtacaatcatagcaaaaacaaacagataatacaagaccgtagatattttgctttttacccgtgtcagccaccatgccgtcatcgccgtcagcagtacgatcagcagcacggaaaataccgttatgaagatggaatatccggccgccttgatcagccctgttttagccacgccgtcaatatagttattcaggcccacgaacgtatcgctgctgggaagtgcaaaaggctggtcgctgatataaagcttactcttaaaagagttgataaataccaggataatcgggaatataaataccagagccagtacggcaaagatcacggtcatcaaagcccctgtgccttttgatacttccattgtctgtacttcttcctgttttctcttctttccagccattagctttccacctccttatttcgcgtgaaatagagctgcgtcagcgccaggattcctactattacaaagaaaataaccgcttttgcctggcctacgccctcccagccgtttctattatagaaagtcgtataaatgtccagcgccagcattgccgtcttcttggacggggcacctgcagtcagcgccaggttctggtcaaagagcttgaaggagttggtcagagtcagaaacaggcagatcgtcacggaggacatcaccatcggtatggtcactttgaacagcgcctgcagctttgtggccccgtcaatcttggcggcctccaccagttctgtagggatattctggatgcccgcgatatagataatcatcatatatccgataagctgccagttcatgagaataatcaggccccagaatccgtatttcgcatctgtcgttatggtcactccgaatctggcaagcacgccgttgatcatcagctgccagatataaccgagcacgataccgccgattaagttcggcatgaaaaatgtagtacggaacagatttgttcccttgattcctcttgtcagcgcatatgcaaagataaaggcgattacattaatgctgatgacagaaacaattgtaaactttacggtaaaccagagggcattcaaaaagtctttatttgaaaatgccttcagatagttttctaatccaacccatcttgcatttgtcactgtggtaaatttacagaatgataatccaataccaagaacaaatggaatcacgaaaaataatgtaaatgcaatcagtgtcggaagcacgaatatgcaaaaatattttttatatgtcttctgcataatactcctcctgttctgtatttgagggtgaggcagaccgattttccggttactattcacggcctgttggccgcgcatagtaacggcatctggctcatttgaagtcgccaatggcgagaagccagatgcccgccccctcactttattggctcggatgccgtgcagcctggtgcacggccccgtggatagtaaggttttccgcacgcctccttgtttttttattcagctgttgcttctttttctgctttccagtcttcgatacactctgttacgactgtgttccattccttattgcctgacgcatattccagaagtgatgccccaaggttgtctttgaatgtctggctcgggaatgtctggaagtcccaggatacacttgtcaggtctggattctccatatagcggattacttcctgtgccagcgggtcggtcggcttctggtcgtcctcaaaggtgttaaacggtgtgataaatcccagttcatttgttactttgtctttgccttcctcggaactgaacagccactggataaagtccagagatgccttctggtcagcctcggaagcttcgctgttgatgcagaaatagttctcgccgcccacgcataagccctgtttctcttctcctttgatgcctgtatagatcggaagatacttgatcttatcttcttttactgtattgccgtcaacgccgctgatgtctccccaggcccagttgccgttctgtaccatcgctgcttttccaagcgcaaattcagccatggaatcggaaacggtcttagaacctaacatagccggctctgtaacggaattattcagataaagatcaaaaatattcttgaactcttcgttatattcaaaagtaatctctttctcatctttcacctctttatcctgatactcataatagatcggaaggttcatcagatgtgtctgccatctccagtcctcgccgggtgcaaaggatgtggaagcaaatacgccttcaatgcccagctggtctttcttggctgtcatgtcctcggtcacttcttttaacttatcaaaattgttgatctcttcgatagaggaagccttcgcaccgtccagagcaaagtatttatccataatctcttcattgtagatgatgccgtatccttccactgcatatggaataccgtatacgcctccgtcctcccccttaatggccatgtccttgtcattcagccaggagtacagatctgtgtccgatagatccatgcagtagtctttccagttctggtatcccaccggtccattgacctggaacagcgtgggagcatccttctttgcaatctcggacttcagcgtctgctcataggttccggaagccgcagtctgcacttttacctgcaccccggtctcttccgtataagctttggcaactgcttcccactgttctgcctgctcaggcttaaagcttaaataatagacggaacctttatcatctttttgggatgattcgggggatacggaatctgttttattgctcccgcaaccggctaaaagccctgcagtcatcgctgctgccagtgcaactgataaaaactttttcatcttcatacttacttctccttttctgaataaactttttcttgtttccttttgttttggaaccgttatcggtatcgatgtcggtaacgtttccaatcctggtattaaatatacacctgccacattataattgcaatcccagaattaagattctgtaatttctcacagttttttcttacgtattttgtgcaatttgtacaggtgtattgagattcgggacgggcctccgccgcaagacgccgtccccaactgtcttcttttttcaacatcgctttgcggtgcactttgtatccagtcattagatcttatacggtgcaatgcccaggctgttttctgaagccagtattatacctttttatagtttccagatatctctattatattcctctattgtcctgtctgaggaaaaatatcccgcctttgcaatattaaccagcatcttcttcgcccattcggtcctgttcacataagctttgagcgcttcctcttttttcttcacatactccttgaagtccagaagcgtcataaaccagtccttgctcagcagttctttctgcaggcgctttaagttttcctcattccccaccgccagcatttttttgctggtgataaagtccacggccgccttgatatcctgatctttttcatagaaatcccgggacacatagtctgcctttgcatagtgttcaatgacttcatcgctggatgctccgaatacaaaaatattatcatctcccactagttggtggatttccacattggcgccgtcttccgtgcccagcgtaacagctccgttcagcatgaacttcatatttccggttccgctggcctccttggatgccagggaaatctgctcggaaatatcacaggcagggatcagtttttccgctttcgtcacgttataattttctaccataaccacctggagataagggcttacctcttgatccttgttgataatctcctgcagacataaaatcatatgaatgatgtcctttgcaattacataggccggcgcggcttttgccccgaagataacagtgattggggtggacggccgtctgccctctttgatttccagatatttgtggatcacatacagggcattcatctgctggcgcttgtattcgtgaagacgctttacctggatatcaaagatggaatccgggttcagctcaagcccctgggtatctttcagataaccgcagagaacctgtttattctccttctttatttccaggatacggctcagtacactctggtccccgcggtaattcatcagtctttccagctgttttgcatcagaacggtatcccgtacctacaacaaaatcaagcatttcagtgagcaggggattgcagtggagcagccatcttctgaatgtaattccgttcgttttattattgaatttttccggataaatcttataaaaatgatgcagctcattatctttgagaatctcggtgtgcagagatgcaaccccattcacgctgaatccgtaatggatatcgatatgagccatatgaaccgtatcacttctgtctataacagccacactctcatctgcatactttcttctcaccttatcgtccagcacttcgatgataggaaccagttggggcaccacctttttcagataatccaacggccatttctccagcgcctctgccagaatcgtatggttcgtataggcacaggtgcgtgaaacaacatcgatagcctcatccatctccagcccccgctccatcagcagtcggatcagctccggaatcaccattgtcggatgcgtatcgttgatctgtatgaccgcgtaatccggcaggtcatagagtctgcagccttttgccacacattcatccagaataagccttgcaccgttgctgaccataaaatactgctgataaatacgcagcaggcgtccattctcatcactgtcatccggatacaaaaacagagtcagatttctggcgatatccttcttatcaaattcaatcccatcctccacaatactctcatctgcagtctccacatcaaagagatgcagcttgtttgttatattgttgtatcccgtaacttcgatatcatacattctggaattcagtgtcattcctctaaagctgaccggataggacacatccgtttttgtcagccagctctgcttctcaatccatggattcggggtctctttctgcagttcctcttcaaactcctgcttaaacaggccgaaatgataattcaggccgattccgtccccgttcagccccagcgtagcgatcgagtccagaaaacaggccgccagccttccaagtcccccatttcccagggatggctcaggctcgatttcttcgatctcacagatgtctctgccgtttcccgccagaacatcccgaacctcattgtaaatacccagattgatcatattgttggagagtaattttccaattaaaaattcagcagaaatataatagagcttctttttgccgccgtttctctctttttgccgggccatttcctgcacgatctccagaagtgcggaatatatctcctcgttagaagcttctgaaacttctttccccagtttctgtgtcatagtatcctgtatactcataatattactcctttcataaaaactccaattggccttatattaagtctatgtcagaaacagtccaggaaggcctgaactgttacttatgttatgcattttaatacgattcctgttcattttcttgcaaaatactcttaaattatagtacaatactatcattctttgataaatcacctacattatacagaaagcgagggaccgttttgaatatcacggagtaccagaattaccatgaaactaaatcccatacaaatgctgattttccttataatacttatctatgttccattccgcttgattttatacaagttccgctccactggcacgaagaaattgagtttattgttattaaaaaaggtcagggccaggtatccgttaaccttcagacccgggacattgccgccggtgatatcgttttcatccctcccggccagctccactcgatccggcagaaagacggatgcagcatggagtacgaaaatattctgttcaagcctgagctgctggtgtcagatagcagcgatctctgtactacacagtttctgcagcctctgctgtgtgcagaacgtgccgtcctcaccttcctcaccccctcctgttccgcatatgcggatcttgccggctgcatcagccatattgatgacttatgcgccgcccggccggagggataccagctggcggtgaaaggatatctctaccagttcttttttctgctggtctcctcacagagaaacagagattccgccacaaaaatcaagacgaaatctctggaaaaattaaaaactattttaaaatatgttgaagatcactatgccgatacgatcacgatagcggatatggccgcccttactttttacagcaaatcccactttatgaaattctttaagagccacatggatatggggttcacagaatatctgaacgactaccgcctcagcatggccgcccggctgcttaccgcctccggcttatctgtactggagattgccacaaggacgggttttgacaatctctcctactttaacaggctttttaaacgcaaatacaggcagacccccggagaatacagaaaggccctaacagattaggcaagcctgaaatgtcacaaaagctgccacttatgacagcttttgttctcctgtatagtacatttcaatcggatcaatgggatcaatggggttctctacctccatcttctctttccttccgtggcgtttaagaagttctccgcctttgttataaaaccagaaagagtagacaagcactttattgaccttcccgatccggtcttttgtcgtcttctcatacagcgttcctccggtctccagctttgtctttttgtggatcatggagatcagttccgtttcgcagttcaccggctcaggcagaatggtataggcccgtcccacacagcccggcttatgggaatcgcttccacccaccgtaaccttgccatacttttcggccagcttcaaggcgcctgcattggatgcctcggattcacaggaattaaatacttccacaaaatcaaaacgcttcatcacttccgggttcgtataaaatctctttgtattcgtaatgctcagatacttctcgccgcatgggtgcgcaggcccgagaatcccaccgttgcggtgcaccaggtcaatcaggacggaaacgggcatgccgcgcatctccagcagcctcatcttaaccccctccggcatgataaccaggatgtgtccggcatcccttgtgtcatactcgattcccttcaatacaataaaatcggtatggatcttccccttcatgtgatgcttccaatagcggtatcccttataagtattgtgatctgtcaccaccataccttgaaatcctttgctctttagaatcgtaatgtattcatccaagcttactttgctgtctatagaaccttcctttacatggcagtgcatatcaatcttcataagtaagccccctttttagtttatatatttatatgtattatacaactttgtcagagggctggcaataaattcacagtcttttcatctgccactttttttcagtgtcctgtgctttactttatttcaggggctttacgatttagttttatatttatttcatattctgtccattttcctgccgttctatctttccaactatatccactatgcccaggatgcttccgacccatcctaatatatacacatatcccggaacctgaatttcggtgaaacaataaagtacggccataatcaacagtacagccgctccgattcccatggcagctgcgctcagcaatgattttcttaatgacataaaaaacacacctctctctcatatgaatccatcatatcagaaaaggtgtgtcataaaacggactttactttttcatttaaagttcatttaaaatcattttaagttaattttaaactattgtaattggaactaaaagtgtattataatctcactgtctatttatcatcgtccagatccagaatagtaatatcatcatccaggtctccgtccaattgcgcctcatcatccggaagttcttcgtcttccagatagtcttccccatccagcagatcatcatcttccagataatcttcctcatccagcagatcatcgtcttccataaattcttcttcattcaggaacgcttcgtctgcctctgcttcgttctctgcctccaaagctgctttactggcagcagcccctgctgcagctgccgcaccggcagcaggattcttctttttaacaggctctgcactgtccagattgtctatcatagcccttgccttgtccacttcgttggcagtagaatgctttttccttatctcttccgcttttttcagatgaagtcttttgcgctttttggattccagtaagaactgtacgatcacacccagaataaccagtaccgcgataaccgcaatccgcacaatctcattttccagaggaagcagcccatagaccgcctgtcccgcagtaaatccaccgaacagtgaagtgataaccatcgtgaccggctccgcgaacttcagagtaatcaatccgattaccaggccgattccaacacaaacaagcagatagatccaatccgccggctgtataaagtaagcactggccacggttcccaggaaccacccgacaacaaagacccccgccagataaaaccgcgctcccagagccgctagaattacaccagtaacaagtcctataatccaggcaatattatcactgacattaaaataataggccgcataagtaccgcctgtcaccccaatcatcaggccaaagaaagccgcccagaaacgtaccatcttcagcccaaagaaacaaaacagcaggccaatagctgcaagcacggccagagtaatcatatcatccggtgtcaggttctgtcccttcgttgtcaatgccgtcaggccgccgttgatctcgacctgcagtctttgaaatattaagttcacttccattttgtaaatctccttatcccttgttaatatttaccttcgttccccgctgtcatatacctccgagatctcccgcagcagagtcagatatgcatccgccacatgcgccggtgaaagaatccttacatccttcccgagtcccgtcagccatccaaaaaacggatcgctcaccgccacttcaaccctggcgataaaatgctgctcaccatccggcctcacagatacatctttcccaaatctgtcaatgacaacacctatgtatttattatgaaatctgatacgtaaggtctcctcctccccaccaaacataccaaatgtttttttcgcataatgggccagatcaaaccggccaaactcctctctgccagaccttggctcctccagaagctcgatctccagcatcttatccactctgaaatgcttcagtatccccgcatccatatcgaatccgatgagataataattctcgtcatcccacgtcagcgaccacggactgacctgataggggctgccgcccttcttcagacggatggttttgtcaatcgtccactcaaaatacttgaaaagaatctgctggttcgaagcaattgccgcgtgcagcttgtctatattataatagatactttcattcatcgccttgatcctgttggttaccacgacctggcgctgcagctgtttcgcctcatgtcggctggccagcccttcaatcttgtggatcaggttgtgtgatttcttctcagtgataaatctggatgactgaacggcatctactaaaagtttcagctctgccagttcaaattcatgtcctgccagatagtagccttccggccgctcctttctgtacgcaatgtccaggccaaaccttttcagcgattctatatcactgtacaggctctttctctctgtctggattccatactctccaagcttttcctccagctgttttctggataatggatgttctgcgtctgtttcttccagaaacagcctcatcagatacaggattttctccttttggttgcaagattttgccataatattctcccctgtataatcccacattttagggtatgtttgaaaattcattgccgcaaaagccactccattttgcaaccatgaatctcaaacacttccaaacctgtacctatcttattttaacaacattccttaaaatatacaatataaagatggatgctaatctaataatgattaacacccatctctattctgatatctctatcattctttttttacctctttctctatcttttgatagggtttggtttttaaattaagtatgctggcggaccgtacctcctattcttagacttccttaccggacttagattctctgatcttctctccctgatggattttacttctctcataactttctcgtcattatgataatttctccatctctcttttctaatcattcactgtgatccggtaagccaaaactgtattaagctttcatttacgaaaaattttcatcttactttttaagattacttcttctttttaaatgattgttcaatcagttttattcttgttataataataacattcatttcttatattgtcaatatatttttagttttttatcttattattttatagttatctgttaattcgtcattccttactcctcattgacttctttatcatgagaatgtagaataggaatatcggattttcaatattattaaggtatagaaaataacaaaggagtttatattatggaacaattgacaattccccaggggtaccgctctccccttaccatacgggaaaccgaagtcgccatcaaggaaataaaagaccatttcgagcgttcactggcgaagtcactccatttaacccgtgtgtccgcaccgctttttgtccgccccgaatccgggctgaacgacaacttaaacggcgtggaacgtcccgtttccttcggaatcagggagcaggaggatgcccccgctgagatcgtgcattctcttgcaaaatggaaacggtatgcgctgaagcactatgattttcattccggagaagggttatatacggatatgagcgcgatccgcagggatgaggatactgataacatccactccctctatgtggatcagtgggactgggaaaaaatcatctcgaaagaagaacgcaatacggaaacactggaatatacggttcgcaaagtatacggcgcattgaaggagacagaagatttcatttccaggcgctataattacatagaacccctgctgccggatgatatttacttcataacatctcaggagctggaagagatgtatccgggcaaaccgccgaaagaaagagaacatttgatcgccaaggcaaaaaaagccgtatttatttcccagattggcaagacactggcttccggccaaaagcatgacggccgtgccccggattatgatgactgggaattaaatggggatattattgtctactatccggtactggatatcggtctggagctttcctccatgggaatccgtgttgatgaggatgctctgagaaaacagttaaagcttgcaggctgtgaagaccgtgccgaactttctttccagaaggcgctccttgccggagagcttccctataccgtgggcggcggaatcgggcagtccagaatctgtatgtattatctgcgcaaggcccacatcggagaggtacagtcttccatctggcccgaagatgtgctgaacctggctttggagaacggaatacaacttttataattaggaacaggagggaatctgacggcatacgccgcagattccctcctgttttctattcttctctcattttcctaagccccacagccattgaatgctgtgccgcatgacgatcctccactaaatcttttgcatagcggatcaccccattattttcatagggatcattaaaataatatccttcctcatcgtaacctaccaacagcatacagtgctcgttggatatccaggtaaactcgctgccgcagttcctcagcttccagcatgggccggtaattggttcgcgcatgttgatacatgcccagaaaacaacgggcatcccctggtcaatgtacatttccagcaatttttcaatcggagtccctgtctcatctacaacttcgtaggaatctccagccgctttctccagcgctcttttgatgaccggcgcataacagccaaaggattcttcgtcataggggctcccgcagaagcattcgttaggatttggcccgtaaagctctccatcctcttcttccagcttcccaagctccagatatttttcaataaactcatccacagttacagaataccccagatactggagcagcataaccgctgatacactctcgcaccctgtcgggtatttgacactttggtctatgtaaggtacctcaagtttaatcatctgcaatcaccacatcacttttcggcgtaaactttttcatgagcgacaaaacgataaacagaattgcaaggctaagcaacaacgtaatccaccatacttttacaaatccggcaataatataaccaactacgcaaacgattgcaacaaccatcgcatactgcatctgcgtcgatacgtgattgatatgattgctctgtgcccccgccgaggacataactgtcgtatccgagatcggagagatatggtcgccgcacactgcgcctgccagaactgcagatacagcaataaccatcatttccatattattagcggaagagaacatggcaacaacgatcggtaccaggatcgcgaaagttccccaggatgttcccgtagaaaatgccaggaaaattgccaccgcaaacataattgccgggattgccacgcttgcggatgcattcgcccctactataccgcctacaaaatcagcaataccaagcgcgtctcccattcctttcagagaccatgcaaaaatcagaatcgcaaccgccggaatcatcagcttgaacccttccacaaaactgtccataaagcccctgaatgtaattacctttcgcggcagatataaaataagcataaatataatggtcagcatggttgcaaaaatcaggcttgtctccgcatcacatcccgcaaatgcatcgactacgcccgtggcgccgccctgaaaaccggtaaatatcatggcccctatggccgaaacaatcaacactacaacaggaagtaccagatcaataactcttcccttagcagaagaagtctcctccttaatctgatcaaattcttccgctcctgtggtaaacagatccccttttgccgcattttcctcatgttttttcatcaggccgaaatcaaaacccgagatgataataaataataccatggcaatcgtcagcaatgcgtatagattgtaaggtatcgttcttaagaacagctggaaacctgtgataccagcatcctcaggaacataagaattcaccgctgcagcccagcttgaaatcggcgcgataatacagaccggcgcagcagtggcatcaatgatgtacgccagcttagccctggaaactttatacctgtccgttaccggcctcattacagaacctaccgtcaggcagttaaaataatcatccacgaaaatcagaagacccaggcccgtagtagcaagaagtgcgctcttcttcgtcttaatcttgctccccgcccagtttccataggcggcagaccctcctgatttcgccatcaacacgataatcataccaagcagtacatcgaatatcagaatattcagattcatactgctcttcatgatatcaaaaaatgcaacaaaagaatcccacggctggaacccggtgtacagcaacgctcccaccgcaacaccgatgaataaagagctgtaaacctcttttgttacaaaagccagaataatggctaaaagcggcggtaccaaagaccaccatgttccgataaacattgaaccgtccataaatcaacctctctctcatttttattcctgtatcttattcctcagttttgctcctgcaccgcccacaaggtataaataacgggatgttcctgtggatacctgattctgcagttctgctgaaggcccgtccgcctggcatcaggtgcgtggtatctccatggatacttcaccgcacagcctctctcccggaaatatgtatggcaggcattctccggggcgaaaaaacgggaaaatacagatatggacgcgtctgcttttgccgacactatacttattttatcgaatgaacgtgcagaatacaatctttttttgtaatttgtgtgggggcgctaagtgaaaggcgggcctggttcccgcggcggggaggtgtatgccatttcaatatcctgcccgccgcgggaaccaggcccgcctttcacttagcttgacgcatccaatcggtaaaaaaagatctccctgccgggaggggctcacccactaataccgcccccttaaaccatcacctctgcgcgtgccgggatggaggcagctgcccccgcccgggataccgcgattgaggatgcttttgccgcaagcttcagcccctcggacggttccattttttctatgatggatgtgatgaaatatcccgtgaaggtatctccggccgcggtggtatccactgcttttacgggaaagattgcctgtcggcatatgctgtcaccgtcctggtaaactgcgccgtcacctccgagtgtgagtacggtttttactgtaggataccgttttctcagctcctgcaggatctcttccggctcctgctttccggttacctgtgctccttctatttcgttcataaggaacatagacactttggagtagtcacaggtatccagggcactgttataaggggacggattcagaatgatcatcatctgttttgcataggcctgatcgatcatgtagtccaccaggttgacctcattctgcagcaagagaatgtcccctttgtcaaaatgtccgagaactgtatctatgtattcttttgtcatcttctggtttgatccgccgtataacaggatgcagttctgaccgtttttgtctacctggattatggtatgtccgcacggtccctccagtttttggataaagtctgtgtgcacgcccgcttctctgcaggtatcgatcagaatctccccgccgtctcctacaagtccggcatgatatacctctgcacccgccctggcaagcgcgatagactgattaagccccttgcccccgcaaaatgtctccattccataagaactcagcgtttcacctggtaacaccatatggtcaaccgaataaacgtagtccagatttaaagaacctaaattcaataccttcatgactccctcgctttctttgccggactcctgtccgccaatctatttcagtattttcatatacagattattatacaaaatccggcccgcaagtacaaggacggatatcctaaatatcctaatatcttattctccgttcctttttatatatggagggattttttgatccggagttgcaaggatgtgattcgatacgtattgaaacttctcatctccttttgggcgcacagtcacctcatgtgtaaaggcacaatctgtattttcgtcttcccagacggcctccacttttaacgtaagagtgccgtccccattttctctgtatgaggtcacctccggaaccggcagaatgcaggaaggaaagtctcccataccgcgcactttccacttatagcttccttcacccgcatcaaatgctgacatgatttgcagtactgcttcatctacctggagccagggctgcatcacttccgcaaattcctgctgcgttgcttgtatttcatcatcgtgtacattggcctggcgtccctgttctatcccgtaaagtttttcatacaaatcttcaaaactaagttcaccataatcattttctgaccagtctgttaaaaacagattgttgtcctcataccctaccggcagaatgtattttctgttcaactcccggcattcctgatccagcggttctattcgcactgcatgatggccggttggaccgtcatagcccggaggctggtatttttcaaataataaataacctttctccgtataactccaagtacaggctgtaaatgtatccaggtaagaggcagcaggttcaccgtctgcccaggatacggcataccggtctatcttcagttcttttttaccggactttaggctgtaccaaatcaggcctccgtcatccagcaggcgcaacagtactgtatcgccggattccccctgtaccgcacgggtacagaagtcttttatggattcaaaattgtacatgtccagttgattgtcccaatccacagcagaatatccagcatctccaagcttttttaagatcttctccttcgttgccagactgtccagtgcctggctgtcccgcgcttccctgtatattttttcatacaggctggcagcattttctgcctcacggagagtctctttgtcttccagttccttccggccgtctggtttttcattcgtatcatgcgtgtccacaccggactgaaccggactgccttccaggtccggctccttctgtccctgacagccggacaaagagagtataaaacctgccaacataaacagtccacttctgcagcatttttttattctattctttatcattatgcctgctcctttttgtatccaccctgtgtatatctatagtgccagatttctgctcccgccgttatagaaagacatttcgcagtttgaatctaatcattatatcagcttattttttaccttttactcatagtccatccttggtatgtagtcagaaatactctcttttccgcccgccaggatatgattgcccacatacttcatatgtccgctttcatcaggcttcatcgtcacttcgtgtgtaaatgcggcgtcctgcccctccagaatatatactgcatccaccaccaatgtcacggttccatcctgatgatgtctgacctctacaacctcaggtacctgctgcgattgatgtgacgtattccatagtcccacagccgtccagtcatagcttttctcttcttcatgatagcccggcatctgctgcagcttctccgctgatatcggaaaccaggatgttattacggcctcatacagtgcagcgggtacctttcccgggctctgccggtcatcgtaagcctgcccgtgttccatctcatataatatatcaaatacatcattgaacacaatcttatccatggatccttcatcccattccgtcaggaaaagattgcttgctttatattttaccggctcaatataatttctgcagtactccctgcactcttctgtaaggggcagtacacggtacatgctgtgcatgtccaattcatggtttttggactttgctttctccagcataagccagcccttttccgtatatctccagtcatacatctgaaccttttccatataggaaatattcggacccctgcctttttcccacgctgccgaagcataggtcatcaccagctcacctgcatcaaattccaaccgtctccactcaaacgtaccgcttttggtaactgtaaaaaactccgttgacactgacttccccagctctgcctgcctcagcacttcatccaaagcctctgcacctcgcatattataatcattggaactgcaggacgaagcatatccctggccggcaaggcagtctgtcagccggtgcctatcctcctccttcagcacaacattatccgcgctgcccttatccacactttggtaaatatcaccgcagccttccaccgcctgcagaactgtctcacgaatcctgctcttttcctcttggctcatcgaaaccaaaaccggctccatatccttcgtgctctcccgctcatccggacgaagcatccttatatcaacagcctcttcatccgcagactccggttctggatcccgttgagtttttcccatttcccagatcagcatactgcccgtaaaggctaatatcactgttataattataacagccgctttttttttgctcatgccgcctccttaatcttacacttgtaggatttcataatattacacctccatcctgcaaaagtcaagaggaacacaaaagggagattccaaggtacatgtcatagtctggcagtaaccatgtaatccccgcggccggaatccccctttacactttattaaattcagatacaacggagcagccgctccatcttatttacaccctcacgctgtgatgttatgatagcctgcagaatgggaaccagctccggacagatatcgaagcgaaggacattctgagacatttgaatcgcgccctgatggtgcgggatcatttcacgcatgaaatccgcattgatgttattggatgcacaagtattctccattttactgaacatcgtctgcgtaatctgctgaaaggcattttgatataggcatatatcctgctgtgaattctgcgctttgctgcagcactggagtatattctgcatattcccgatgctttttgtctgttcttcaatgatatttaaggcaatatcctgtaacggcacgcaagtggtatactgcagcaaattttgtgacatttcaatcgctgctttgtgatgtggaatcatctgaacaatgaagttgtgcgaaaggctgtccgtaagctctgcgcctgtcatattctcaatcatttcctccaatatcccataaaagcagcagaggtatgattttgtaacattactgaatctttgctgatcctgcataatttattctcctctatgatggcctgatctcgttccctaatgttattttatgcggaagaacacagtttggttacagaggcgcaacatatgatattttataaaaatgcttcaagaatcccggctactggcatggcaggcagcagagaaactttcgttactgttcacacctttcgggcttgtacagtaacgacctctccccggatgcatcacttcccttgtgttttccttcattttgttttagaatgttctcaatatgaggtgatattatgacgattcaacagttaaaatacataattaagattgtagaatgcggttccattacggaagccgcacggcagctttttatttcccagcccagtctgtctgctgccgtgaaagaactggaacaggaatatggcatcgagattttttaccgcacacccaaaggaatctctttatccgcggacggcacggagtttctctcctatgcacggcagattattgaacaaacggaattgatggagataagatatacagacaggaagccggccaagcagctctgctccgtgtccacgcagcattatgcatttgcagtcaacgcttttgttaatctgattgcgtctctggatgcggaggaatatgaatttacactgcgtgagacgagaacttatgaaattatcgaggatgtgtccaattaccggagtgaggtaggtgttctttatttcagtgatttcaatcaaaaagtattacagaagctgctcagggaaaaccagctggaatttacaccgctttttcatgcccacccccatgtatttgtcagcgctgcccatccgcttgccgcagcagaaggggtcactctggaagacctggagccctatcccttcctaacatttgaacagggaacatacaactccttctatttttcggaggagattctaagtacggaaccccgccggaaaatcatacatgtcagcgacagggcaactctgttcaacctgctgatcggactcaatggctatacgatctgtaccggcgtgttaagcagtgatttaaacggtgatcatatcgtttccgtcaaattaaaaactggggaaatcatgcgtgtaggcctcatcacaaacaaaaaggcgcccttgagctctgccgccaaaaagtatatcgcagagttgaaaaaattgatcggagaatacggatatcctgtgctgcagtagcaactgtatcttccggctatgctgcaagcacccggtgtaccgcttcatatatcttcgcggctatgtaaggattattcattgtatacaaatgaatcccgtcaacgccctgtgccgtcagatctatgatctggtctgccgcgtaggcgatacccgcatcgcgcatcgcttccggattatgctcgtagcgctccatcattgcggtaaacttgcggggcagatgcacaccgcacagcgataccatgcgctcgatctgttttttattgacaaccggcatgatcccggcttgtattggtacatggattccggccagagaacatctttccctaaatctgtaaaaataatcattgtcaaaaaacagctgtgtgatcagctgatctgcaccggcatccacttttgttttcaggttacggatgtccgctgcaatagtttccgattctgtatgcccctccgggtaacaggccgctatcacgttaaagctgcagcgttcccggatgaaagcgatcagctcgccggcataccgaaagtctccgctcatctctccgtcctttgggatatcgccccgaagagccagtatattttctatccctgcctccttaaaatgccggatctgcgataaaacatcctctttgctcaggccaatacacggaagatgcgccacactctcgatgtggtaattattcttaacagccgctgcaatctcaagagttgctttgcagttctcgctccctcccgccccataggtaacactgataaaatccggatgcagcttctgcaattcctcaagggtactgtaaatggtatctacggcccccgttcgtttcggtggaaaaacctcaaaagacaaaactgtatgttttttaaatatttctgttgttttcatggctaattttcctttccctctaagtgtgaaaggagtatagcatgaaaagaacattatcaggtaatatacattttatatagattggcatagaaaaaaactatggacaaatcgttttcccgttctttccccggattcacagcaggatctccgccgtcgttccatctgcctcagttgatctataaaacaatttccagccatgcacaccggcaatgtcatgacaaaggctgataccaaacccatgccggtctgtataagatgccggagtcccctggcttctgttcatccatttcagcttctttccgctgactgcctggccgtcattccacacagtgattcggtaagcatccgcactgactctcacccgactgcccccggcggccgcattctgaatcagattttccagcatacaccgtaccagtgtcctgtcgccctgcaggaaatcccgcatgcaattcacctcaatgtatgggtacaggctctgaatatcatttaacatgtgtgccagatctatcttctgcatcagaaccctgccttcccgcacgccgcccataatcaacaatttttcgacgatatcattcatttcccgcgcactttgttccatctgctgcgccgcaaaaaagcgatcctcttcacttagatttccaagcatcaggtactgcgcatacccctggattcccgtgagcggagtccttaactcgtgggcgatccggctgacgggccggttgatccgtttcatcgtaaagtacagcattccacccacaactgcagacagaagtacccccatcccagccatgaaaagcgcacgccgctgctgattctgctgcaggggagccatactttccatatatgcaatttttgtaaccgatcccgcatttaccagtctgtcctgaatcagcacataggggatattctgatgttcgatgatctgtacaggtttatcgttgggcagatccgccggtaaaaggtctgcttggattcttccatcctgttccactctcagtttcacacccgagagcatataactccgtaacaccgacgactgattgattcgtgatgtatcaccttcatcagtttggatttcccgcagaaaaagcgcaattcccttttctcccgagacggcccgggccatccactgttccagctcattcctgtagagaaggccatggagaagaagcaggcttccgtagataataaacaggaacatcataaatgtaaccagaaagtttttcttccataactgcatgttatatctccaatcggtaaccgtatttgaatatggtcctgatgtagtcttccatccccagtttctgccgcagacgccgaatatgtacgtccacagtcctgtcatccccacagtagtctatcccccacgccagatccagaagccggtccctggacagtgcgatatttttattctccaggagcaccttcagaagttcatattccctggttgtcagctctaccggtattccgtctttcctggctgcagccttcgccgtatccacttccacgctgcccagccggtaatatgtctgttccttgtgctggcgtctcagagcagcctggattctggctacaagttcctctactgcaaagggcttcacaatataatcttctgccccgccgttgaggcctctcaccctgtcttctatctctcccctggcagtcacgcagatcaccggaatttgtttccactgcttcaaaagttcaaatccgctgatgtcaggcagattcatatccagcagaatcaaatccggaaccttctggtcaacggcctttaaggcctcccgtccatcatggacaggaagccccctgtgtccggtcatgcggacggtacgcctgatcaattcattaatgctcttatcatcctcaacaatcaaaatatctgccattgatgttcctcttctcattccgtttttatacacctgttacttaaaggaagaccgtttacttgggatggtccgatgtattataagccctgataccaatttcaatcagttcctcttcggaaagatttgagacaactgctgtgtctccgttgatacttttttcccggcagaactgctcgattactttttcagccccggaaaatgcataaatatccccaatgtaagcttccagcgaccactgtgtcgtaccgtcctcctttttctccgcatgtttcgcatacaacggacagccgccgatattcttcagaagccagagcgcttcctcataattcgtcatatcccgtgtaacctcgcccatagtcagcgtctcaaaatccttgccgaacttctcacatgttttccgcccaagatctgcatcatccacaaagtcgcaatacaaatcagtatccttccagccaggtgaatatgtgacttctccgtccgtcaaactttcctcaacttccttcgatgctgcctgaaccacatccttttctgccatagaattagaccagccgatccctgcccccaacgcagccgtcatacagatcacaagccctgctgccatcagtgcaactttgtacctgctccattttgccttcataaatatactctcctttctgcttattataacttcctattgtgcagcacgtaaagaggaactcccccttacaaagcgatcatactctccacatattgcagacttattacaggaacaggaaaaatttcctatatcataaaaaaacaggtattctctgccgctaatatagagaatagcccgtatctattacccagaggccgtcacttaaaggtgacagttcaggcagggctgaactgtcacctttggcggcttcttttgggatgtctatttggagatttactgaaaacgcttttatttctgatacacagagcgaaagttctcgtatgtaaacttcatattttcctgcagactgctatactggaatggaaggtcttttgtgattttttcaccggtaaataattcattatccgcttcggtaagtggaaatggcagggggatatttttttctataatctctttgagcggcagttcctctactgtaaacggcagatcactgatgctttttagcagccggatgaatgattgatagtccaatacttccggggcgctcagaatgtaggcctgattcgccgccttctcttcttctatacagcttacaatcgcatttgccacgtcttttacaaagaccatctggaacttacccgaagtttctttcggcaccgggagggacgttccctctattatcttcttaatataataggattctctgggcgcgtagttgaacggaccgtagataaatgtgggacgcaggactacatattctgcatcatgctgccttgtgcttacaaataattctttttctaagagcattttgttgtatgtatagctttgtacctggtctgctcccccttcgctcatcattggggactcttcattccttattcctgctgtcttctcatgtacatctgcagtactgatatagatatatctgcggacgctgcacggcaggtagctccacaaattctcaatatccccaggagcatatgcacaaaaatccaccaccgcatcatattctttttccagcggaagtttggacaccgtctgatagtcatgcctgtcacaagcatattctgttacattctcataggacttaacggagaatctccccctgttcactaccgtcagctcataccccttttgggatgccaccatgacaaatactcttcctgtaaaatagcttccaccaagtactaaaatctttttactcattgtcttccctcctttaaaaactaaaaaaagtgaccgctatgattgcgataaccataaatgcagccttccgctcaacctcatgttgcactgattctatcacttccgattccctctgtcaatcagctgtgacagtcacttttgccttgacggttacaagcggaagcattcactggaattttgcgggtttaaacaacagaatataggacgcccccttgcaagcacaggcaaattgatgtagcatttaaagaaaataataaaaaatttcgaatgcatccgcataaatacaggccttttgacgatttcttccacttaattccatttcagatattacttcccatagagattgtgaaagaatccacatagtccgaattgaaagtgcctgttatgtctgttataatcgaaaagtatgaaaaagccgaaaaccggcaaggaggaacttatatgaaagtcattgaaggttatatgccttatctcgggtatcagacttattaccgtattgtcggggaatgcaaaggtaataagaaaccgctcgttttactgcacggcgggcccggttccacacacaactattttgaggtgctggacaagcttgctgaggaagggcgcgccatcatctcctacgatcagattggctgcggcaattcttatgtagacgggcatccaaagttatggtgttccgaaacatgggacaacgagctgattgagctgagaaaacatctcggtctggacgaactgcatctgcttggacaatcctggggaggaatgctcgcaatcgaatacctctgcgattataagccgcagggggttaaatctgttatactatccagcacgctgcctgctgcagaactgtgggctcacgaacagcaccgtatgatcaagtttatgtcacaggaggatcaggatgcaattgcaaaggcggaagagaccggtgattttgatgatccggcatatctggccgcaaatgacagatttatgctgcttcactgtgcaggagccgtaactgaagactcaccggaatgcctgcgccgtccgaaaaagtccggaaccgaggcttatgtggcaggctgggggccgaatgaatacaaccccactggcagcctgggcggatgggaataccgggataagattgtagatatgaaggaacctgcactgataatcagcggtacaaatgacctatgcaccccgcttgtagccaagactatgtatgatctgattccgaattcacgttgggaattatttgacggatgcaggcatatgtgctttgtggaagaaaatgagaagtactgtgcactcctgaatgagtggatggatcagtacgattcatagggtggcttctcagatgacaggcctgcagagccgtacaaaattcttataggtatatatcatacggaccgaagaaccctcatgaaaaagagttcttcggtccgtgcatccgaaaaaacaaattgtaatttgaaagaatttgtaacagttcaggctgctctgaactgttacaagaattttacttctactttgcaatatagataccgtccgctccaagcgcgctttcgtgtataaatatccctccgtttttctccatccggaaacgccgaacaaaccagtcgcatttgcagagaaaaagataataaatgttcagcccgcatccatgaagcgactcaaaatttccctgccctttggatataatcatatcagcaccgtgaatcagctgtgaggcctcatcgctgatatcacgaagggatgttcccgggatagcagttccatttcctattacaggcacgacatctgtcaggccggtctcttttgcgtcctcaacagttgcatcattgattaccgcctctcctcttacaattgctgtaatccgaagatccgggtactgcttcctcaaaaattcgatcagcagcttatccaatacgatctcaccgcagttatcggtcagatataccaggctgccgcctttctccaaatccccttcaaagcgtttcagcgtatccttatcaacctgttttttacccgcctcacgcaccagcatatccagaaccgagccttccacttcccgcagggcgccaaaatctatgtaattccctgttcttgcaaatgaaagggcgcaggaaagcgggtcttcagccgcttcgatttctttcctgataccctcctccgccagctgcatttttttgttaaaagaatgcttgattgggctgtaatccacacttttcccaaaatatttttcatatgccttttgtacacaagccgacaaaacgggtgtcgtgtcctcttccctgctgctgccaattatgcggaggacttccttcagatatgctgattttatctgctcatcctcaaaatcctttatgttttccgactgtttatccaccatgcactggatacatgctgcacttatcctcattcttttccacctcattataattgaaccggcagcctgtctccaggctgccgattatcccttttttaccgttcacagtcaaacctgtaaacaatgactacggattctcactattcacattataggtgttttttcccaagagtgcaacctttctgactgcaaagcagattactatcgtgatcagcatatccggcagcgtgttgcccacgggcatatcaacatgcatcagccctctgtatgccagaaatccgatgacccatatagccagattcggcacatttactgctttgctgctctcgtcctttttcaacaggaagaaatctgctatctggatggcgatcattggagcaaatacagaaccgatcaggtagaggaaatctgtaatatcatccatggggaatgcaattgccgccgcggttccaattactgtcaccacgattcccacctgcttggggctgattcctttgataatagattcgctggatacccccgcagagtatgcatccaaaaacgtggttgtaaccgtagagaaaataatgatcagaagccctgcaatgcccagtcccgccttcaccatgatggaggcaatatttccttcgccggtaaagatagcggcccccatacctatggtatacatccagcagcttacgatcccatagacaatggcactgaccgcggttgctttcaccggctttgccgcctcacgtgtatagtcgctgatcagcggcagccaggacagcggcatggcaacggaaagctctaccgccgctccaaatgtcatcccctccggactgatcattccgggggctccgcctccaaaaaaaatcaccttgcataatatcagggtcaggataaacagggcagtcattgccactgtattaatctttccaagatttgttatcccgattgcgatccacaggataatcagcgctccaatcaccaggcaccatacccaggcacccgtcttcacaacgccattggcagccagggctccgtcatatatcatgatagatgtccagcccaccaactggagcacattcaggatagaaaacaaaaggcttcccttctgtccaaagctcatcttaacggtttccatcgaactctttctggttttagccccgatcaggccggccaggaaaagcatggtacagccaatgacgtggcccagtataatggcgagcagtcccttagaaaaccccagaggagccaggtaggtccccgtcaggatctcagcaattgaaacccctgcgccaaaccagatcaatccgttttcaaaaatagatgttcgttttgttttcatgtttagcccacctccatttctgctgctgatgcctccgccgtaaagcagccatctattgcaaatccgtggttcataggcccgctgccctgccccagatccagcatggcccccagggcgccggatatataatcttttgcgcgttctactgcctgctccatcggaaatccttttgccaaattggaggcaatggcgctggaaagcgtgcatccggtgccgtgcgtgttcggattttcaatccgcttaccataaaaccagtgggcgcttccactgctgtataataaatcatttgcgtcgtttaactcgtggccgccttttaaaagcaccgcacactgatatttggtactgattgctgctgcggctttttccatgtcctcttctgacagaatctgcatgcccgaaagaacctctgcctccggtatatttggcgtgattacctctgccagaggaatcaatttttcttgcagtgtctgcacagcgtcttcgctgatcagcctggaaccgctcgtggctaccataaccggatccagaacaatgtgttctgcccgatactcaagcagcttgccggcaatcgcctctatgagcggagatgatgataccatcccgatcttcactgcatccggccggatatctgtaaaaatacagtccatctgctcctttaaaaattctggtgttacttccattattcctgttacgccggtcgtattctgagcggtaagcgcggtgattgcactcatggcgtacacgccatttgctgtcatcgtcttaatatctgcctggatgccggcgcctccactggaatcgcttccagcgattgttaatgctgttctcatgatctttgtttcctttctttatgtctgcattaattttatagagcggcagagagtggtgcccccggtctgccgctgggtttattgctttccttttcttggtggcctgtctgaattcagttactgttcagcccgtgccgtgcactttgctgcgcaggtactgaattccttaaatgttttcagataataatcggctgtttctctaatttccttctcctgtccggcactgtatctgtcgtagacggcagcagtttgaaagcctgcttttcctgccgtcttcagggcatgcagaacatcttcgaaaaccaggatatctactggggctgcctgcagccttcgtgccgcttccaggaaaatatccggctttgtcttatctgtatgcatctccgaacaggtcaggatctcctgaaaataggacagaattccatgtcttgtgaacgctgcttctacattcacgcggtcactggacgtcacaacaatcataggaatcttctgccttttcagttcttccaggcattccggcacgccttctttgagaggggcttcgcagctgtagaacccgtacagcattttattgatcccctccatggcctgccggatatccagctgcagtccatagtgttcaatcagatattgtgttccctgccttgtactcatcgtgttcaggattctgctcagtcccggctctggtttcacacccatggattccagatatctctcgctgagattctcccagatttccatggagtccagaagtgttccgtctacatcaaatactgccccctgtatccgcctcatcttttctcctgaagcccggatacagctgcgtcctcagaaggcacctttaccatcgcttccgttaatgtcttcagttcccgcgccgcttctttaatatcctgctgtgcaaagagtgcgctgatgactgcaatcccgcagataccgctgccggcaagttccatgacattgcccgcgccgatgccgccgattgcgataaccggaatatccactgctccgcagatcgccttgaccgtttccatatccacttctatcgcgtccgccttagagccggtaggaaagacagcccctacccccaggtaatcggccccgtgtttctgtgccagaagggcctgctctaccgtctgggcggatacgccgatgatcttatcttctcccagcctcctgcgcacatctccagcttccatatcgctctggcctacatgcacaccgtccgcatccacggccagtgcaatctcaacactgtcgttgatgacaaaaggaacctgatactttttacagagcactttaatctctctggcttcctccagaaaagcctccgtctccagatccttctccctcagctggataaaagtagcgccgccttccagagcatcctgcacctgctggtacagtgtggactctcccagccagcttctgtctgttaccgcatataagagcagctcttccttaccgcacttcatagtttgcacctctttccagttcttcacccgtcatgttataaatagcatctataatgcggttcctgtaggttgcatttccatccccgtcctgcattcgtgcaaatccggtctctcccgcaagccccatagcgcagactgcagccgcagccgcttccagcttatgatccggattcgccgtaataaaggcggtcatcataccggaaagctggcaccctgttcccgtaatcctgcccatctcgggacgcccgttgcggatcacataacaggtttctccgtcactgaccaaatcaattgccccggtcacagctgcaatactgccgcagctttttgaaaaggcttttacgaaggctgccgcctgctccaggttctcctccgtcactgcatccgccacatctgcatccactccctttgtcgtaccgctcccctgggccagtgtcttgatctccgaaatatttccccggattacatcgaattttatctttgccatcaattccttcgccgtgccggtcctaagactgctggcccctgcgcccacgggatccagaagcacggtgtgccccagctcattggccttctcacccgccaggatcatactgcggatgctccgctggttcagtgtcccgatgttgatattgagtcccccgcagatcgatgtgatatccaccacatcctccggctcatccgacataatcgggctgccgccgcatgcgagcaggatgttcgccacatcgtttactgtcacataattggtaatattatgcaccagcggtgacttttccctaactttgtcaaaacattctctcatcatggtacctacctcctgtgtatcgttattttgaatgtaaaaatgcggatacaccaaaataaggcatatccgcataaaatgcagttcaatgtatccctacgttggcattatccaaatcaggttatgggtctaagcaatacagcttactctcagcctgcttcatgcaagctcccctttccaggttttacagtaatcattatactctattctcaaagaatttcaactataacttttataaaatcgggatttagtcggcaagctttagacttgtcgacggacggggacgcttcatgacagggaggccgggaaggcactggggctgtatatgccgttgcgatatgcacccgtgctgctaagtgattctagaacacccgatgccggataggcgggtacgctgaacacatcacgggaaatctgatgatttcccgcgctgggttcagcaaaaacttgatttggagatcaagtttttccccgcctatctggcatcggctgttcaagaatcactaagcgcactccagcatatcgcaacggcatatacagccccagcgcctccccggcctccctgtcataaagctggctcatccaatcgacaggaaagctcgccaaccgggtgggatcccggaccagggcagcggatgtggattggctatgcgtatcttttcatcttcaagatgtgtattgaattattttgatactggaaccgtaacccattgcttatgtacacctactgggggcataaaagtcccgccaattcaataccatacgctgcccccgcttgaggcctctccttagaaacgagcttttttctgccggttggatgcgccagctccatgaagggatagctgaaagcctcccggagaacatccatgtcctttcaaaaacgctcaaagcggaccttagaaattcttggtgggaaacagcccggaaaatggagagatttttggattccgaatccaaaaatcagctgacccagcgcgagaaatcatcggatttctcgtgatgtgtcagtggtgctccattttccgggctgtttcccaccaagaatttcttaggtccgcggccgcgtttttgaaaggacatggatgttctccgggaggttttcggctatccctttatggagcgcccccatccgcgccgagactaaagctcgtcgctaaatcccgatttattggtttgggagtgatcagcagcgtcccggtaatactctgtaatctctgtatatccctgctctatcaactgttctttctggaactttttattttttttcatttttacaatcaagacctgcctgcccgccgcgcgttctctttttgcaagctccaatactttgagcattccttcagccggcaggttcttttctatcagaaatgcttttttctccctgcctgacggcaccacaaagccccgctccagcaggagcataacgatgcgttcaaatccgatagaaaaaccaaccgctgggatattctgtccagtaaattttccaatcatttcatcatagcgcccgccgccaccgacacttccgccgaactcatccattgcgatttcaaaaatggttcccgtataataggacattccccgcacaagcgcaggatcgaaaataattctgaaatttgcttcttttgcgcttttcacactggtaatgatcatttccaatgaatccgccgcctcatcctcaagaaaaccttttagtttttctttgcagcttcgtacaccttccacatcattcgtaatctctttaaataactgaagatatttgtccacggattcttttgcatatccgttttcctctaattctgcagccacgccgttcactccgattttatccatcttatccagtgtgatgaggacactttcataatccgcttctgcaaatccactgtacgccgccattgctttcaagaatctgcggtcgttgatacggatagtaaaattctgaaaggaaagttttccaagcagcgtcgtggtcgccagaatcagctctatctccgccaggtttcccggttcatccagaatgtcaatatcacactgcatgaactggcggaagcgtccccgctgcggcctgtccgcgcgccacacattcccgatctgcaaagctttgaagggagatggcagctcatttgcatgattggaataataccgggacagcggcaccgttaaatcataacgcaaaccgccatccaccagatcgctctcctctttggctgtatcgatcttcagcttttctccgcgtttcaaaatcttaaagattagtttttcgttgtccccaccctgtttactacacaaattttcaatatgttctacacagggagtctcgattgaggaaaatccaaatgatttatatgtctccttgatcagcccaatcacataatccctgatttccatttctccgggcatcatgtccttcattccggtgaccggttttttctttaacgccataaccttactccttttttaaacatcggtaaaataccaatactttcgattctattttctgattttaactgccagggcatgtgccttcatcccctcggactctgcgagctgaatgatatgatccgcattctgctttaatgcagcttccggataatgaatgacactatatcctctcataaattccaatactgacatgccagaagaaaattttgcagtcccgcatgttggaagaatatgatttgttccgcagaaataatcgccaacgggttcggtactgtactcaccaacaaatactgcgccggcattcgttaattttgtcagtgcatcctgataatcatctaacaacagttccgcatgttccggggcaatttcattgacggcatccacagcttcttcgatagaatcaacgataaaaatgtctccataattttcaaatgttttttgagttgcttttacaagaccatgttctttgcacagacggttgatttcagctttaattttttgtgcctgctcttccgataaacagaaagcagtacttgcctcaaatcccgttccgtgctctgcctgagacatcatatcagcagcaataaaaacagggttcgcatttctgtcagcgataattgcaatttcagaaggcccggcgatagaatcaattttcacttcgccaaacaaaagcttctttgccatttgggtaaagttattcccaggacccgttattgcatcgactttcctgacagtttccgtaccatatgcgacagctgctaagccctgggaaccggaaattttataatagtttctaatatttagatagtcagctacataaagtaaatgttcatcaatcgttccgtctattcttggttttgtcagtatgtatatgttcggaactccggccacgatggcgggaatcacgttcatatatagtgtagagacgagcggcgccatatttccgggaacattgatagccagactgttaatcggagtatatcttcgttcgagtacagcgccatcctggtaggtttctgaaaagctcacaggtaattgctttttatgaaatctcattaaattgtcacaggctctttttacagactctttaaattcttctgatactttttctcttgcatctgcaaattcttcctctgttacgaataagccgatttcattcatatcaacatggtcaaatttcttcatatactcatacaaagcttcgtcgccccgtgtctttacatccttcagcacttccctgaccgtagtttccacctcttctggaatgctgcttcttcgtttaagaagatgattgaatcttgggttttcataactaaatttgctgattgttaccatggcttttctccttttcttttgattatatagacgtttgtaaaacgcctgaacccgttgttttactgggttttcttacacttaatatgtttgttctctgttctggacgtttacgttttaaaataaaaaaaacgcctgcaagagaatttttccctaacaagcgtggatcaagcatctgcctaatatcagttaaaataatagcaatacaactctcatttgtcaagcccaatgttatccaaaaactgtcttgacaagccaaattagttaagctataataattaaaacaacttaaccaattacaaaagagaaaattaaacttcacccggggggatgtaaaccaatggatttaaaaacggctttggatgcattttattacagtacagttttatgtgacctgcgactgatgaacaagcagtttgtagatgagactcttacctataacagcctgctctatctggagcttattttttcaatgaagggaaaatgtacggcttccagaattgcaaatttactccaggtctcaaaacctgccattacgctaaaaatcaatgcattgatccgtcaggggctggtgctgaaagtaccggatcctgatgaccgcagacagaacatcttaactgtcaatgaggaagcggtactgaaatacaaagtctaccgcaggcaggacaatgaagcgatcgcacgaatccaagaaaatttttccgaggaagagatccagcaattttgcagaatgttagacattatatctacaattaactacgaggaaattgatgtaaaatgagaggtgagagaatatgaaagttcttttggtagatgagaggttttttgattttaatttattgcggaattgcgtcggcgacggcatctgctcgctgttggacattgacatgtttgtgacgggcaatgaaaaatccacgccggtacaaagccttgagccaaagccggataaaccagctttttcagaagcatccttcgacgtatcccgcagaaaccagcagcagatgatacttaatcaggctaaggattacctggacaatcattacatggattttgattgttccttatcttctgtagcgaaatccatacatatatcacccagttatctgagtctcatatttaaaaaagtagtggggataacatttgtcaattatcttactcttttacgcatcaataaggcaaagcaattgttatcctccactgatctcatggtctacgaggtttcgacaagcgtgggttatgaaaattattcctatttcagcacagtgtttaaaaaagccacaggtctttctcccagagaataccgcttgaattaccaccacaaagaagagccctgtgacctatatttctgaaattaaaataacgccgacaatacacataattatgccgaccaaccgtttaagggtaactttttctttatagaaaacggctccaacaatcaccagggcaattgccagtaatacatataataagacacttccaacactgagattccaccccatacggaacatcagcagtacggatacgtccatacatacaaggcatatgccaagtgcaggtgcagtccagttgatttttttcaattccaacataaagttttgcccttttttcgttaaaaaaaacattccaattacaacgacaagacacacaccatagcacagacaaagagaaacataaggatcgatggtttctggtgtaaccttctgaataatcatataaggaacacgagaggcaaccattaagattgctggagccagataatttaattttgtaactttttttgtatctttcatattttatcctccattgtaaatgtgacattaggttatattttttttcttgcggccttttcaggggaatttatgatataaagtccaaccgcgcagacaattacaccagtaattttcatcgcggtgatactttctccaaaaaaaaacacaccaatgattacaacaattactgagcaggcaatattagctatcaaagatccaatgctgatatcccagccggctctgaataataaaatgagcgaaagatcagcaaacacaatacacactcccagacaataggacgtccaatttgcttcagcggccgcagcaagcagatttttttctctgcttgtcataaggaacagggcaatacaaaccagaagtgccatacagtaggtaactgcaagagaaacaaaaggatttattttctcaggtgtcgattttcctactacattgtaaaatacattgcccagaattcccaataaaagtggtgaaataaatatcaaaaaactcatataaatctcctttccgcgcgccttcgggcgctgcatgaatcgtaataaaagtattgaggctcaggttcttttaaacgaactgtttcccctctaatcaatagtgaaaagacgcgcctgataccttttatgatatcagggcgtcttatgttttattcctccgccttccagctggcatatctggtatagactgccatggtcttccccacatggatatgcccccccgggatctgcacaatgcggggctctttcccctctgcctcccggatctttacctctcccttttccaggcgcttcagggccgggctgtgccctgccatgtagccctcctgccccgaggcttgctctaccacgaccatctccacttccccggaatagaataactgctgcggagttacaatctttaataaaaaactttttgctgccatccgccctaagcctccttctgcacacggtccgcttccgggcctcccttatgcggtctgcccctgggcgtacttctctgtcacgtcgtcaatccctcctgcaaacaggaacatggattccggaatctcatcgtgcctgccttccaggatctctttaaagccccggatggtttctttcagcggcacgtacttcccggccatccccgtaaactgctccgccacatagaacggctgggacaggaaccgctgcagcttccttgcgcgggctaccgtcagcttatcttcctccgacagctcctccatccccaggatcgcgatgatgtcctgcaggtccttatatttctgcagcacctcctgcactccacgggcggtctggtaatgctcctcccccaggattaacgggtccatgatccgggacgtggactccagcgggtctaccgccgggtaaatccccagctccgtgatcgcacggctgagcaccgtggtcgcatccagatgcgcaaaggtcgtcgcaggcgccgggtctgtcaggtcatccgccggcacgtatacggcctgcaccgaggtgatggaaccgtccctcgtggacgtgatccgctcctgcagcgcccccatctccgttgccagggtgggctggtagcctaccgcagagggcacgcgccccaaaagcgccgatacttccgaccccgcctgggtgaaacggaaaatgttgtcaatgaacagcagcacgtcctggtgctccctgtcccggaaatgctccgccatggtcagccccgtcagcgccacgcgcatcctggctcccggcggctcattcatctgcccgaataccatggccgtcttatcgataaccccggattcctgcatctcataatacaggtcgttcccttccctggtacgctcgcctacccctgcaaacacagagatcccgccgtgttccttggcgatgttgttgatcagctcctggatcagcacggtcttccctacccccgctcccccgaacaggccgaccttccccccttttgtgtaaggggccagcaggtcaatgaccttgatcccggtctcaaagatcacagaagacgtgtcctggtccttatagtccggcgccgggcggtggatcgcatcgtaacgctccgcctctacggcgcccttctcgtcaatcgtctcgcccagcacattgaacaggcgccctaatacttctttcccgaccgggaccttgatcggctcccccgtgtcggtcgcttccatcccccggtacatcccatccgtggatgaaagggcaatacaccgggcctgatccgcaccaatgtgctgttccacctctgctacaatggtctttccgttttgctcgatatgtattgcattaagaagattcggcatctgttcctcatcaaacttaatatcaataaccggtccgataatctgttgaatgattcctttattcaattgcctcacctcttaatttctgagcctccgagccggcgatgatctcaatgatctcactggtaatcgccgcctgtctcgctctgttatagtaaatagataattctgtcagcatctcgttggcactgtcgctggcattcttcatcgcaatcctgcgcgccgaatgctcgcacaaggtcgcctccgcgattgcactgtacaggtacaaagccaggtactcctgcgccaggctgtcaaacagctcccgcccggccggttcgtattccatcagggtcaggtcacagtcccctgcctgcccccctgcctccagcgggaacaccggggccgccttcacctcatgggaaatcgagttcaggtaggaagcatacagcacccggatgcttgtaaaacggccttcccggtacagctccagcacttcccctgagagccggtacgcttcctcgtaccccatctcatccatctgctcccgctccgtctccagcatctccaggccttcccggatgcagaactcttttccctttgtcccaagggccgcgaaacagcagctgcctttttcttcctctgcgatctgccccgccgccttcgtgatggaggtattgtagctcccgcacagccctttgctgctggtgagcaggatgtacagcgtttccccgtcccttggttccaggtacacttccggcaccccctcctcggtacgcaggacctgcccgtaaagccgcttttcctcctccaggtgtttccggatatagtcgaaccggttcgttgcctgcttcagtttcgctgcggaaaccagtttcatggcattggtgatcctctccgtgctgctgacgcttttcatcctgcgcttaatcgcctgcatctggtcagccatcgaatctacccgccttcctgcattcttctatgcccttcaaaagctgttcctctgtctccgcttccagtttccctgtatccgcaatggctttccccacatgggggtaattcgtatccatgtactggtacagttccttttcaaaccgcttcacctggcttggcgcaatgcccgccagatgcccttttactgccgcataaatgatcatgacctggtgttccaccgcaaccggctggtactgcccctgcttcaggatctccatcaggagcatgccgttctccagccgctctttggtatccttgtcaatgtctgacccaaactgcgagaaccctttcagctcccggtactgcgccagcatcagcttgatcgttcccgccaccttcttcatggccttgatctgggcgctgccccctacccgtgacaccgagatcccggcgtttaccgcgggtctctggcccgagaagaacagttccgactccaggaagatctggccgtccgtgatggagatgacgttggtcgggatatacgccgacacgtcccctgcctgggtctcgatgatcggcagcgccgtaatggaacccccgcccagctcatcggagagcttcgcggagcgctccagcagacggctgtgcaggtaaaagacatcccccgggtacgcctctcgtcctggcggacgcctcagcagcagggacatggcacggtatgccaccgcgtgtttggacaggtcgtcatatacgatcaggacatctttcccttcatacatgaattcctcccccatcgcacaccctgcatagggcgctatgtactgcagcggcgccacgtcgctggccgtcgccgacacgatgatggtatagcgcatcgcatcccggtcttccagcgtcttcaccagctgcgcgatggtcgactttctctggccgatggccacatagatgcagatcacgtccttgcccttctgattaatgatggtatcaatggcgatggccgtctttcccgtctggcggtccccgatgatcagttcccgctgcccctttccgatggggatcatggcgtcaatcgccttgatgcccgtctgcagcggctggtgcactgacttcctctgcagcacccccggcgccgggctctcgatgggccgcgtcttatccgtctctaccgggcccttcccgtcaatgggctcacccagcgggttcacgacacggccaaggagctcttcccccacaggcacttccgctacccggcctgtcgggcggacaatgtccccctccttgatgccccggtctgctccgatgataaccgcccctacattcttttcctccaggttcatggccatcccgtagatcccgccggaaaactccagcagttcccccgccacacagtggcgcaggcctgtcacacgggctaccccgtcccccacttcctgcacggtgccaaaatccgtgatctccatctggcttgtataggtttctatctgctttttgatctggctgctgatctcctctgtattccacatcatagagaactccccccttccggcctgcttcgaagcctcaagcttaaatcttccattctcttcttcagggaagcatcaatgagtttcccgtctgcggagatcaataccccgccgatgaggccttcatcgatcatgtttaccagggtcaccggcttgccgatcagttccgccgtctgctcttccaggcgcttcaccatttccttctccagcggcaccaccgaatataccgtcccacggatcccctgtctttcttctcccagaagctccagcccttcggccagcacctggctgaaatggtacaggccctggcggtctaacaggatgcagaagaacgccagcgtctcatcgctgatatggctcccaaatatgtcccgcatccactcaagccttgtttccttcccgatttcacccagcgtcagcatctggaaaaagttctcttcctccataaggagtcttttcagcacagccagttcttcagtcactgtatctatttgcccgcacagtttctttacctcagtctgttctgttattctttccatgatgaatcctcagcttcttctataatcttttctactacttctgcctgtcttttcgggttcagttcttctcctatgattttccctgctgcaaggacagccatgtctccaatctctctttgtagctctttcttcgcaatcatcttgtcccgctcgatttcacggcgcgtctgctcccgcacctgccccgcttctttgcttgcggtctcaagcaccgcccctgcctgggcctgggcctcctgcattgccttctttatgatctcccgtttctcggactctgcaaacgccatctgcgcctcatactcttccagcttctgctgtgcctcttcgcgcgtcgtctgggcttcctgcagcgtgttcaccacctgctgctgccttgcctccataaactggtgtactttctcaaaaaagaatttttttaagattaacactaacacaaccacggtgatcagcgaaaaaagcaggttccagttgattgtaagcagatcctgatataattgtactttcaaatccggctgcctcccttctctcttatacctttcccgacagcataatggcgataacgaaggtcaggacaccgatggtctccataattgccatacctacaatcatacctgtctggatcttgcctgctacttccggctgccttgacatgccttccagccccttgctcagtgccagcccctgccccaggccgatgcccagtgctgctaatcccatacacatcccgattcccagtgcaaccattcccatatctatttcctcctgtaatcaattcctattattttttctttgaatcttttcaaaaccatcagcagatacgctgcaagcccatataagccgcctttcgcagtggggcctgctttcgcatatttgatattttcgtacagacaatcctgtaaatacaccgtcctgtactgatttactgtctttctttttcctttactcgctgtgtcccacagacattattttgactgctgcaccgaggtttatcacggtcagcgtggtaaatatgtacgtttggattaacggttccgctatgtcaaagatcgcattcagcggcagtaccgtaaccgcacgcagaaacgggaccgtcgtaatcatgttgcttaggtgcgtcatcagatgcagccacagttcgattacgatgaaccctcccaggatattcccgaaaagccggagccccagggagatcggtaatgtgcactcctccaggatcttcagcgggaacatgaacgggtacgggtcgcacatctctttgagtttcccctttaccccgtgcactctcagtgagttggccaggatcatcaggaacgtcagccctgacagggcaaacgccacatttaagtccgccgtaatcggacggatcccaaacagccccaggcagctcgcacagaatacgaacccaaggatgctccctacatagggcgcataggacttgttctccttccccatgttgttctccgtaaacttatacacccagcccacgataaattccgccaccacctgttttcctttcggtaccgtcttcagcccgcttccgagccagatccccagcaccgccagtatcacggcaatcacgagtccaaacaatgtactctctgtgataaacagctttccctctccgaagcccaatataatccgggcgccgagttcttccacgtttatcattgtttttttactcctcctattccagatgcgataaatattgccagtgacatctctcctcccttaaaatgtgtacggaaaaggaagtgctgcaaatagcacctttcggctgccgttcagcacctccccttgactttctcagagattcccggaggctttggggctgacgggaaatgaaattaacaaactataaattgaggcggactatgaagtcagtaatatatagtttgaatcatgcattttccgacggcctcttctccccgaagatgtccccacatttttatgcaagactgacgagtataactccgacaagtgctattccaatacctatcagacgttttgtagtcagtttttccttgtaggcaacacgtccaagaattaccagtacaattgccagtaatacataagccagcagcagtcccacgctcaaatcccagcctacgcggaaaagtaaaatcgttgagacttccaggcatacaaggcaggcgcccagtaccggagccgtccagttagctttcttaatctctttaaaatagtttttatttttacttgtgataaagaacattaaaagcgcataaacaatgcagaccaagtatgtcagagatacggaagcaaaagtatctacatcagaaggagttacctttgcagttatactataagcaagatttgctacaatcatcagcagaactggcatccacataagcagacccttctttttccctgcagcattgctctttgtttcctcaccttccaacacagcagtcttgttcttcttctccggggaattaaccacgtaaagtcccaggatacaaacaacgataccgccgcccttaatcatagtcattgcttcaccaaagcaggcaacacccacaactacagacatcagtgatacaccgatatttgcaatcaaggaaccgatgctgacatcccagccgacccggtataacaaaataagtgccagatcaatgaatacaatcgtcaggcccagcacataagaagcccagtttgctttggaaacagctgcaagtatattcccccctggattggttacaaagaataaaatcacacacaataccataccaaccatgtagcttaaggagaggctggcaaacgaatttaccttttcgggtgtaccctttcctgccacattatagatcgtattgccgaatacattcagcaaaagcggtgcaataaaaatcaataattccataatcagttctcgtcctttctatcatcacatacaagacatgcactatacctcgtacacaatacgtccatcgcaaacagtgagttccacattgcacttcaaaatgtcatccacaggaatctcaaagagattgcaatcccagacagcaatatcggcaagctttccattttccaggcttccaagcactgcttctttccctgctttgtatgcgccgccccatgtatatgcatataatgcatcccacagggtgagtttctgttccggattccaaccagaagcaggctgcccgtctgggaatgtacgtgttactgccctatgcaggctgatacggggatcataggaaacaaccggaaaatcagttccaaaagccagatgaatcccattgtccagcatactcttaaatgcccagaggctctttgtccgtacgggacccacacaatctgcatactgctcgtcctcatacgttggaaagagcgccagatgctgtggctgtaccgaacaaataatgcctgcctttgacatacgtgcccagtctttgggtgaagacatatccagatgctcaatggacattctggaagccgtctcgccattttctgcaatggcatcctcatacatctcgatggttttgcgcactgccccatcccctactgcatggaactgcaggttgataccatttttatgatattccttcacgcgctgcgcatcatattccaaatctgttgcccagaagttatagtctgcgtccgcatcgtctgtgtaaggatccagcagcaaacctgtatgtgcaacaacaattccatccacaaattccttgacccctgaatagtagatcatttgctccggatcgccgtatttcccggtgtgctccaatgcttcctcaatcgtacccgtcaggcaggtagcataattataccgaaacttcagcgcaccctcatcagccatgtcttttatcacgtccaggtttcccatattgtagttattcagtgcacgcatatcaattaaagaagtgactccatacttgcaaatgtcatcactcttttcttccatcagcttgcgttccttcgcataaggaatattaaaagcaagccgcacaaccgggttctgtgcttcctcaaccagatatcccgtgatatgcccctgctcatcccgttcaaaacgaccaaaccgcggatccggagtatccggcgccagtccggctaattccagagctttagaatttacccatgcagcatgcagatcgctgtcgtaaatatataccggacgttccggaaaatattgatccaaaatttcctttgtcggcggcttcgggtcatcccactccgcaatcacaaaaccacaagaactcagccattctccttcttcatattcgtcttcatgcgcctgataatactcgtacagcgattttgcacattcttctgcgctcgaataccctccaacataaggagctgacatcatataagcccctgcaaacaaatggacatgtgaatcgcatatccccggtgttattaatttggtgccaaaatctctaacatccgtatcctcatctgccagtgcaagtacttcttcttttgagccaatgcaaagaattttattatctgcaatggctacccctcctgaaaccatccccagtgaacctgcggtaaatatgttttcacttagtaaaatcatatctgttttcatcctttatgtacctcctgtaattttatctattaaaatatagcaactcttaatttgaatgtaaatcaatattatttttgaattctttcgtttttttgtgattctttcatttttttactattatgataattattttaattatttttcatattttttgtgcaactattccgagataccgaagagtttacagaaattaattttcatttttttcacagtatcgtcaaataaatatagaaaaaaaggaattccatagttgaatatcaacatatggcatcccttttcttctgttacagcatctactccctagaaattcatctgcactgaagggggctgcgagccattacgcacgtttagcatgggccaaagcggagcaaagactggatgtctgcagccactatattttcttacggtctgggtagcaaatgcgcagacctgtctaatctgttaccaaacgcctgccgggagcattccatctcacattatgcactttctatgaattgctatttatggtatagtataataaatgtactctctttcgttgaaaagaaaggatatcctgtgaataaaaaaacgaacattaaaattaattatttatataaagttttgcttctctgtgctgtactggtttttctgtatgtgttctacagtatctttcatatagaacatatgccggacagccgtttcataccagatccgcctgtcagtttatccgaaggctggtatacccttgatgcttcgggcggaaaaacggctctgcctgaacttaatacctggagtatgaaaagtgatgcccctgtaacaatccacagggaactgcccccgctgtccgacaaggattacctgttcattgagaataacttcaactacataaaggtctttgttgacggcgcctgtatctatgattattctgacgataccgtagacctgcctgccaatatgtcgggccatttcatctgccagattccgcttgaccgtgacttttccggacggatcttatctgttgagattactcagccccatacgtttctcagtgtcggagttaaagatatctcgataggcacggcaagctcctatattatacaatatctttattctcatgccgaactaatcatcagtttattcgtaatgcttcttgccagcctgtgcctattttctgcctttctctggcagaagcacagaaagctggattacaattattccgtatttggtgaactttcgcttctgacactaatttcgactttatggatatttaccgattcccagcttcctcagttgttttgggggaatactgtcgccgtctgtgtcctctctttcttcagttttatggtgctgccactgcctatgctttctatcaccagcacactgtgccaggacagccgaagagttcttgctcgtatgaaatgtattctgatcttaaatgctgtggtccagggtattctatactcttttggaaatgtcagcctggtacgtatgcttccgattacacatagcctgatcgcgctgaacggcattgtactgcttctatttttactgcacaggctcaaaggcagttcgtcccatttagcaaaacctatgctgctttccctgattctgctgatcctctccgcagtactggcgctgatacaattttatatcaacccgcaggcagataacagccggttctaccgttatggctttattctatttatctcaatcctgatttacgtaagcataaaagctatgctgaattttttaaataattataccgaacataaaatactgaaaaaactggcttatacagatatccttacaaacgtgggcagcagactggcatttgaagagttcatgaatgaactcagaagccgcacaaccccttttcccggagtattttatgtctgtgacctgaacaacctaaaagtaaccaatgatacttacggccacaaggcaggcgatattatactaaaagaagctgcccgctgtatagcaaaagtcttccaggattccggaagaatcttccggatcggaggcgatgaattcgctgctttcattcaggcaccgttccatgaactgcctgattacgtctctatgctggagaaagaaatcgagagcgcggacagttcctgtgagtataacttctctctttcaattggctgggatgcttctgatacgatcataggaaatgaaatcgacagaatatttcgacaggcagacgacgacatgtataaaagcaagatgaaataccgggaagaaaaaagaataaaatgaacacaggagaataaagtggtcaagcccacatcgactcccccctcactcatgggggcctgcacactttggcgccgccgcgatgccgcttcgcggctatatactttatcgcggcgtgtgcatcccacggagggttttatgatataggaaattccaaaggaatttcctatatcaataaataaaggcagcgttgttaccgctgccctttctttttattaaaaaccgcttctcttgctacttctgctgcattcattgcatttgatgtgtagaaatctgctccgattttcccggcaaaggattccgttacaggagctcccccaaccatcagtatatatttatcccgcagcccccttctctccagctcagccgtacactcttccatccggatcatcgtcgtggtaagcagtgctgacatacatatgatatccgcgccaatttcctcagccttatcaatgaatactgacgtttccacatcaacgcccagatcataagtttcaaatccggcacctttgagcatcataatgaccagattcttcccgatatcatgcagatcaccaaagacagtaccaacaacagctttccccacaggctccgcccccgcggcagccagtctgggttcaagttccttcattcccgcatgcatggcgcttgccgcaaccagaacctcagcaacaaagactttattatgcttaaacttcagtccaagctccatcattcctgcaagaagcccttcctccaatatcactttcggatctatattctcggccagagcctgccggatcagagccttaaccattttagcctttcccaattgaagatattcattaatttcctgaatcagttccatacttttacccccgacctgatctcagtggaggataccgatttctctccgcccgccactgccgctaaccttgtttttattgattgatccctccgcctatagggatggcagaatcctcatttatcttgtcaaaaatagtataactataacaatcatatcacatcattcgaataattatctcatacgttcaagcattttacaaacaaaatcgggatttagtcggcaagctttagacttgtcgacggacggggacgcttcatgacagggaggccgggaaggcgctggggctgtatatgccgttgcgatatgcacccgtgctgctaagtgattctagaacacccgatgccggataggcgggtacgctgaacacattacgggaaatctgatgatttcccgcgctgggttcagcaaaaacttgatttggagatcaagtttttccccgcctatctggcatcggctgttcaagaatcactaagcagcacgggtgcatatcgcaacggcatatacagccccagcacctccccggcctccctgtcataaagctggctcatccaatcggcaggaaagctcgccaaccgggtgggatcccggaccagggcagcggatgtggattggctatgcgtatcttttcatcttcaagatgtgtattgaattattttgatactggaaccgtatcccattgcttatgtacacctactggggacataaaagtcccgccaattcaataccatacgctgcccccgtttgaggctcctccttagaaacgagcctttacctgccggttggatgcgccagctccatgaagggatagctgaaagcctcccggagaacatccatgtcctttcaaaaacgctcaaagcgaaccttagaaattcttggtgggaaacagcccggaaaatggagagatttttggattccgaatccaaaaatcagctgacccagcgcgagaaatcatcggatttctcgtgatgtgtcagtggtgctccattttcagggctgtttcccgcctagaatttcttaggtccgcggccgcgtttttgaaaggacatggatgttctccgggaggctttcggctatccctttatggagcgtccccatccgcgccgagactaaagctcgccactaaatcccgatttagttcaggaagttctcgatgataactgattctgcctcttcctccgacatcccaaatgtccgcagcttaaccagctgctcgtcattgatccttccaatcgcggcttcatgcacgatctgcgcatctacatgtttcgcattgatctccggtattgagctgatctcggcctgatccataataatagaatcacactgaacatgtgcatggcacagattgtttccgattgcccttggatggaaaacctgccttgaggttccttttgccacggaacgggagatgatcctggcagaactattctctccgctcagctggacatccatgttcgatactgcagtctgctccgcatgggtcatgagcttctctgtaacgaaaagttttgccccacgggacagttctacaaatgtttcacgctctgtggaatcgacacccttgatctgggtggtctccagtgtaaataccgaattctctccgatataaatctttgtcaccggatttaatactttaccgccagttccttcgccctctgcgtaatggttctctacgtacttcacattcgcatcttttcccacatggaaggcatgaataccgtcgtggcggctctcgctgcagccgtcattgtgtattccgcagcctgctacgattacgacgtctgccccgtcctctatataaaaatcattatatactacatccttcatgccagattcggacatgacaaccggaatatggacctgttcctgctgagcttctccgctgatataaatattaatgccgggcttatcttcctttttttcaatccggatatggcggctgtctccgtggcagactgccataccgttcaggcgcagattataggcgccttcctgcttaaatcccagcgaatctattacctttagtacattttccgtaacctcattaagcttcacagatgtcacctcccttttccttcatgcacgcacaggaatcgatattttctccaagcagctgcggcatgatctccgctgtgggcccgattgaatctaacttcccgtcggatattaccataatccggtccgccatctggataatcttctcctgatgagagatgaggatcaggctctcttttttctctttatggatcttttcaaaccgcttgatcagcatggagaagctccagagatcaatgccggcctctggctcatcaaagatacagatattgtgctttttcgccaaaacagtcgcaatctcgatccgcttcatctccccgccagacagggtcgaatccgcttctctgtctatatattccatggcacacagaccaacactgctcaacagtccgcagcacttttcctcggtcagttcctcgcccgctgccaatgacagcagacgtctcacagtcattcccttaaaacggggaggctgctggaatgcaaatccgatgcctgcctgtgccctttcattgatcgataaacctgtgatatcctcaccgttcataataatccggcccgccgtttccttattaattcccatcagaatctttgccagtgtggactttccgcctccgttaggcccggtgatgaccagcatctctccgtcctccaccgtaaagttgatatcggaaagtatttccgactgcttcccttcctcagatacatcatatgataaatgctctacctgtaacatctctgtcacttccttttcttatgctagccgcacgctttattcaccggaaaactggcggaataatcctctgtaagtatctgcatagatgctccctcgtctccatataaaagtaaaatcatgggtaatcccgaaattcctcagtgaaattactttgagttctctcttttccagttcttccctaactgcgacctcatataaaaatgtaataccacagccggcttttgtcaactctttaatcgcatgtaaactgcctatttccgcagttctgacaaaatcttcggttccataattctgtgaatccagataacgctccagaacttccctggttcctgatcccggttccctgagcagaaggcgttcgccaaacaaatcttccagcttctccggctttttgctaaacgggtaaaaagggctgcacacagccacatagcgctctgtggagtaatgcagataatcgtattcattctttttataaaatccctcaacaagggcaaaatctatctctccgttatccagccttgtaagcagctcctgggtattcgccacttccatatgtaacttcacatccggatactttacaagataccgctccagaatccgcgccatgacaacctccccaaccgtcatagttgcaccaaatcggatattctgatatccatctgtcagatgctgcatattactctgcagagaaagctcgtcgtgcatcatggtaagcgatgcactgcggagcatctctcctgcctctgtcagtttcagcttcttcccctcatactggaaaagttttgtcccgtagtgcttctccagataacgcacatgctgcgaaaccgcaggctgtgtgatattgagttcttcagctgcccttgtgaaattcatgcattgacataccgtcagaaatgtttccatccgaaaatccaacatattcatccctctttaaatgaatccaggcggagcttcctctcctcaaaagctccgcctttatattttaattactccctgtatttactataacatattattatcataaaataaagatatataattttattttatagtttttttatgctatgataaatgtgacagacaaaatatggaaaaagttacgcctttcttgtctgatcaattatctaaatctaaaggtataagaacggaggatttgtaacatggaatttataaaacaaaaaggacctggattattgttctgcctgattattgcaattccgtcatggtttttgggccgggcactcccggtgatcggcggccctgttttcgcaatactcattggaatggtattaacattaatcatcaagcggaaagataccgtacaacccggaatagcttatacatccaaaaagattctgcaggcagctgttgtatttctcggctttggaatgaacctgacagaaatacttgccaagggccgtcagtcccttcctatcattctttccacaatcagcacttctctaatcattgcttttatcctgtataaagcaatgaaactgcagccaaacaacgccatactggtcggagtcggctcatccatatgcggaggctccgcgatcgcagctacagccccggttatcgatgcaaacgatgaagaagttgcacagtccatctcagtcatcttcctcttcaacgtcatcgctgcactgattttccctgcactgggaggaatcctgcatctgagtaatgaaggattcggcctgtttgcaggcactgccatcaatgatacatcttccgtaacggcagctgcagccgcatgggatgggattcacgccagccatacactggaggcggcggccatcgtcaagatgacaagaacactggcgatcatcccaatcaccctgtttctggccctctacaaaggcagaaaagaaaaaaagaccgaaggatcttccttcagcctgaaaaaaacattcccatattttgtattgttcttcgtccttgcgtcggtcatcactacagtattccagctgcccccggcagttaccgcgccattaaaagaactgagcaaattcctcatcatcatggcaatggcagcaatcggcctgaacacaaatatcgtagatctcgtaaaaaccggcggcaagccaatcttcaccggcttctgctgctgggttggaatcgcagtcgtcagcttaggaatgcagcaccttatgggtgtctggtaggcgggattttgggatcgtgctttagtgttgcgggcggggggacgcctgccgtggagcgggacggggggacaggaaaaaacacgttccccggttgggatcccatacggtggggacggatgaaaccggctatgcgtgtcttgtatcttgcttagacgtattgaaactatttatacagtgaattctatatagttttcagccgaatcaaaacatcagttttttcacaaatcatacaaactctattcgtacagataaaccccaatacagatgatccctaatgcgcagccagcccacatccgcctctcccgttaggatccccaccgggaaacgaatcctatcctaccgcccggctcacggtaagcgaatcctccatccgcgcccgagactaaagctcgttccctaatccttattgtactgtcgcgatatcgattaaggtgagtttttgtatgtctgtattttccaggcttgtgatcagcgcctgcgccgtatccatagctgtcagcacgttcactcctgtctcgattgcatttctccggatgatgaatccatcccgggagtggtcagcgccctgcgcggggatatcgatgaccaggtcgatctcgtgtcccaggatcaaatccaggaggtttggagactcctgctcgatcttgcggaccggaatcgccttgacgcccgcctcattcagcgccttggcagttcccgccgtggcaaagatgcggtatccgatgtcggcaaatcttcttccgatctctactgcatcctgatggtcttcgtcgcggaccgtcataatcatatttttgaacttcggaagtttgattccggctccgataaatgctttgtaaagtgcctctccaaatgtcttcgcgattcccagacattctccggtggacttcatctccggacccagactgatgtcagcgccccggattttttcaaatgagaatacaggcatcttgatggcaatgtactcggcctctttctggagtccgggggtgtatcccagttctctgatcttcccgccgatgattacttttgtggccagcggtacgatcggaattccggttaccttgctgatatatggtactgtccggctggaacgtggatttacttcgattacatagacgtcctcatccccgcatacgataaactgaatattaatcaggccgatgacatgaagggatttggccagtcttcttgtgtactcggcaatcttgtcttttgccgcctggctcaggctctgtgccggatatacagagatgctgtctccggagtggattcccgcgcgctcgatatgctccatgatcccaggtatcagaatatcttccccgtcgcatacggcatccacctctatttccttgccctgaagatatttatctacaaggatcgggtggtcctgtgcgattctgttgatgattccgataaattcgtcgatgtcgtgatcgttaatggcgatctgcattccctggccgcccaatacataggagggtctcaccagaaccggataccccagcctgtttgccacttcttttgcctcttgtgccgtatatacggtacctccggttgggcgcggaatctgacactgttccaggatctcgtcgaacagctccctgtcctcggctttgtctacattctcggcggaggtacccaggatcggcactcccatcttcatcaggctttccgtcagcttgatggctgtctggccgccaaactgtacgaccgcaccgtccggtttttctatgtctacgatgctctttacatcctccggcgtcagcggttcgaaatacagcttatccgcaatatcaaagtctgtgctgacagtttccggattgttattaacaataatcgtctcgtaaccttcttttgagaatgcccaggtacaatgcacggaacagaagtcgaattcgattccctgtccgatgcggatcggaccggatccaagcaccaggactttctttctgcctctggttacttctacctcattttctcttccatacacagagtagtagtatggcgtctcggcagcaaattctgcggcacaagtatctaccatcttataagaagctacaatgccgtttgcatggcgcatatcgtggatttcctcttcgctccttcctgtcagggctgcaatcacctgatccggaaattcgatcctttttgcctctctgagaagttccggggtaagttcctctgacttcagcgcctcctccatctcaacaaggatggccagtttatcaataaaccagaaatcaatcatcgtgatcttatggatctgctcataagtcatgtttcggcggatcgcctctgcaattcgccagatacgcatatcgtctacaatcgcaagctgctccctcagcatatcatctgaaagtcccgtgaaatcataagacattaggctgtcaacgtgctgttccagagagcggatcgctttcatcaaggcgccctcaaagttgtcacagatgctcatgacttctccggtcgccttcatctgtgtcgtcagcgtcctcttggcgctgatgaatttatcgaagggaagccttggaatctttaccacacagtaatccagcatcggctcaaagcttgcataagtttttccggttatggcatttttgatctcatccagtgtataacccagcgcgatcttcgccgcaactttggcaatcggataaccggtcgctttggatgccagagcagaggaacggctgacacgtggattcacctcgattacacagtattcaaagctttccggattcagggcatactgtacgttacatcctcccgtgatattcagctcgctgatgatattcaaggcagatgtacgcagcatctgatactctttatcccccagcgtctgggatggggcaacgacaatactatcgccggtgtgcacacccaccggatcaatattctccatgttacagactgtgatacaattccccttggaatcccgcatcacctcgtactcgatttccttccagcccgcgatgcagcgctctaccagaacctgtcccacacgggaaaggcgcagaccgttttccagaatttccaccagctgctccgaattccgggctattccgccgccgcttcctcccagtgtgtatgcggggcggagtacgacagggtatccgatctcattggcaaatgcaaggccgtccgcaacattctccacaacaagggacgcagccacgggctcaccgatcttttccattgtggccttgaattccaggcggtcctccgcctttttaatcgtctcggatgtggttccgatcaggcgcacgttattttcttgaaagaatccggcctcgtccagctccattgccagattcaggcccgcctgccctcccagcgtcggcagtacactgtcaggccgttccttcctgatcagctgttctacaacttctacggtaagcggttcaatatacaccttatcggctatatctttatcggtcatgattgtggccggattggagttcagcagcacaacctcaaccccttcttccttcagggagcggcatgcctgtgtccccgcataatcaaactctgcggcctgtccgataataatcgggccggaaccgatgactaatacttttttgatactgttatcctttggcattatttcgctcctcccatcatttccataaatctatcgaacagataacccgagtcctgcggtcccgggcaggcttccggatgaaactgcacggtaaagatattttttccctgatattgcagaccttcattcgtttcgtcattgacattgacaaatgcaggcacagcaatctccggatccacgctcttatcatctaccacatagccatggttttgtgaagaaatatacacgcgccccgtcagtaggtccttgacaggatggttgccgccgcggtgaccgtacttcagcttatgtgtggccgcaccagtagcaagagccatcagttgatgccccaggcaaatcgcaaaaataggaatatcggtatggtataattttttgatttcttcgataatagaagtgcagtctgcagggtcaccagggccgttagaaagcatgatgccgtcaggatttgctgaaatgatttcctctgcagttgtgttggctggataaacagtcacttcacaaccacatttatttaaagaattggctatattatttttggcgcccagatcgaggagtgctactttcttcccgcttccttccagcacatactttttactgcatgtcactttggaaacaacatctcccaccctgtaagcccttagttttggaagaatctcttccaggcagtaattttcattcgtggtaatcatcccgttcatggttcctttttcccttaatgtcttcgtaagggcacgggtatccacatcagcaatccccggaatatcctgcttttcaagaaaatcctggatcgttccttcacacctgaagttgctcggcatcctggacagctccctcacgatgtatccgtccggccatgccttttgggattccatgtccggtgttatgccgtaattcccgattaacgggtatgtcataacgacggcctgtcccgcgtaagaagggtcagtcaatacttccaaataccctgtcatggaggtattaaatacgatttcacttatcatctcttttttcgaaccaatgctttttcctgaaaacacggttccgtcttccaatatcagaaacgctttcatctgttcacctattcccttcatgtattttgccgcccccgtaagccctgtaaacagcgcccggaaagcaacaaacagaatctcatttattttacatgacaaaggcactcttggagtctttcaatccagagcgccctcgttctcaaattgtaaagattatactacatttaaaaacagatttcaacaaaatttttaaacaacattctgtaacaattttccggaaaattattgatagttccagaaaatcgtgatcttattcatcgtctcatcctctatataggtatactgcacagattcaagtccgtagtattccagcagattctgggccgctctctgaaccaggtcgttcaggatactgtcatgtgcctgctgatagagtgtatcatttgcaaacttgcaggtaaaagaatctgccctgccgtagatggtgtcattcatatccttcagcagctgatccggctgatattcctcgtagtacatgccgttgagtttataatagttcaaatccatagaactgcagggcgggtattccactgtcgtatccatagtatggtttttcatgatttccgcatcgctgcagcaaagataatcataattaatactttgctccggcagattttccccgctctctgtctccaggaataccggatccccgaaagtaacatccatttgatagtattgcccgtcacacttcacgatattccaggcatgcgctccctgtcctggaatcgttccggttacatagatgcactcaatgcctgtctgctgcaatagatactgtgcggcgcgggaatatcccgcgcatacggatgccttccccgccagggcactgtatatgttctgattgtcaggggcctccatattatagtccacagtatttaccaaatattcaaaaatgtatttgatcttatcatattccgaagtattcccggcaattccttcgaagcatgcagatacagcaccatcaatctgcgcctgcttctgtgtccgctcctcctgtgtgcaggtatatacaggctgtacttccgaatagtccgtatagctggtcacctgcatctccccggtacaccagaatatctccggcctgtcgctgaaaataaactggcacacttttttgagcacctccacatcgggtgaatgcatatagatggattcgtcaaaatccatcataccctgataaagctctttatacaggtcctgctccgtttccggaagctgccggtaatagtacccctgtgccacatcgtcttccggtattctgacttcctcaaagggaatacttgtgcttttctccacctgaaccttaaccgtctctattacttcttttgtggacgcaaaaaggcctgggagctgctgaaaagccaccgctcccaaacctgtaaaaatgcctgtcagaatgaatattccggccacgaccggccatttttttctttttttccttcttcctgccataatccttccccgttctgccgctttcccatgcctgtgcagtccccgccgttcgtacagagggagcccaggctccgccggtgcggcgggagagcagcttaaagaagagacctgaacagcgctgcaatgtcctctactgaagtctccttcggattccctggcctgcaggcatccgcatatgccgattcagacaaaaacgcaatgtcctcctcttttgcaatgcctttgaggtctgccgggattccgacatctgcagatagttttttcactgcttccactgccgccctgcggtactcttcctgtgtcatattttcagttccttccacacccatagcttttgcaatctccctgtacttctctcctgtagcgtctgcattgtactccataaccgttgggagcagaatcgcattcgcaaccccgtgcggtgtgtcataaagtgcgccgagtgtatgtgccatagaatgcacgattcccagccctacattggagaatcccatccctgccacatactgtccaagcgccatgtccgctcttccctccggcgtattgtcaactgcgcctctcagggaccgggcaataatctcaatagattttaagtggaacatatctgataattcccatgctccggccgtaatatacccctcaattgcatgtgtcagcgcatccatgcccgtagatgcagtcagccccttcggcatactggacatcatgtccggatcaatcaccgccacgatcgggatatcgtgggggtcaacgcatacaaactttctgttcttttcaacatctgttatcacatagttaatcgtaacttccgctgctgtaccagctgttgtcggaaccgcaataatcggcacacacttatttttcgtaggcgcggtgccttccaggcttctgacatcctcaaattccgggttgttaatgatgatacctaccgccttggctgtatccatagaagatccaccgccaattgcaatgatgtagtccgcaccggaggatcggtacgcagcgactcccgtctgcacattctcaatggtcggattgggcttaatatctgaataaagttcatacggcagatcatttgactccagcacatccagcaccttctgtgtaaccccaaacttcaccagatccgggtcagagcacacaaatgccttctgaaatcccctggcctgaacttcaaccgcgatatcattgaccgcccctgctccatggtaagatgtttcattcaaaataaatctgtttgacatagcacatttctcctttaccttttatagattgccttgcggcatcattgattgttataattataacaaccttgaacacacagagacaagttacaaaatggcggctatgtaacatttatcgttactattcacggggccgtgcaccacgctgcacggcatccgagccaataaaatgatggggtcgggcatctggctcctcgccacaggcgactttaaatgagccagatgccgttactatgcacggcccataggccgtgaatagtaaccatttatcatcactattcccaatcctattcatcctgtaaatcaggctgcagttcagagagcagttcttccagtggctgcgggagcgcctgtatgagcagatcggccatcttctccggggccagatccatatttctcctggcccacctggcagtcatatagatggagcctctgcagtacatctccagcagaaaacagatatcctcatccagcggttttttcgtcttcttttctatgatattcttgtaaaactgcaatatgcattcatagtcataagcaaccagggaattgtaatcctctgactgaaaggctgcagcaaagaaagtctgttcgtttttgataaaccaaaactttttctcaagcccctcccttaaggtcatgctgacacccatctgcagaaaagacttctccgcaagacgttcaaaatgccaattcaccagatcatatttatccaaaaagcagcggtaaaaagtctgccgtgtcataccactcttttctacgatctcttttaccgttatcttatccagcggtttcacgcccatcagtcctgtcatggccgtcacgaacttttgttttgtcctatccccattatccatgttttcacctcaattaaattatagtttaggatcttctaaacttcaaggatgttgtgttataaattacctcaaaatacattatgatcaagctacgtgtttctttccgtcacacataactctcacccttaacaatattttaattctcacaatccttattttatggtatgattaggtaattgcgaaacacattaaaaatgtaagaacgagtggattttgaaaggataggaatgccaaagaaaggtgaataagcagtcaagtggaaaatgtccttagaaaatgagcgcaaggtggaaaaagggcgcactgatagcgggaatggcaggttctctctattgtggagcggctatgctataaggggctttaagctgcggatatattgattcttatgaattttatctgcaaccataacggttacgagctgggaaatgcccgcaagcagcagatctgcatgaagtgttttctcattccgtgttttccgtccagctacacaaaaactgtccttgaaatggtgaattgctttttccacatttaccctgattttatacgtggaagcccactcctgtgtgccccgtacagtgccaggatatgccctgaggtttttttccggatagatatagaacatacgtccacaggaagaatctgtacatgggctcccacactcgcagacccgtttggtcttcctggtttctttattgtatttccacttcatcttggggcagacaaatttcatggtggaaagaccacagcgcagatgcgatttgcttccttcccgtttcattggcagggaggggtccttggggcagcagggaatgccgtcttcgttgagggggcagtctgaaccttccagggaaatccgcccgttcagaggaataaaggctttctcgaaaggcgcttcctccaaaaggtatttgtaaatctgggtggaatcaaaggcggcatcaccaaggaaaaccttggggttaatgagtgggtgcttctggaagaaatcctttaaaacagggattaaggctttggaatctgcaaggctcttgtcatcgtccggagaatctgatcttttttctacaacgatgtccggatgggcatcaagaaatgctttattgtagaaggtgatatcacgaacaataccaagcccgttggtcaggataccaaatttaaaggcgtagcagaaatggtcgttgatgtacatctgctgaatggcaggattagccgcagcgtgggcaggcatagaaccataggcggctttataaggatcataagaatcatccagacctttcgcttttttaaaagctttgagttgcttgataatccgattagcatacttggggttgttttccgtgacccaggcttcaataccggaggtatcaaacaggaacatagaagctttagaagcatccagtgcctggcagattggttccgtcaaatccacgagatgatggaacatcaattgtaagtccaataaaaagtcctgcttgaaacgtgtgaatttagaatcatcaggaacgatatcaaagccacagaagtcacggagttcctgagaatatttgaggaacacaataagaagagaaactgtaggaatggaaaaaatacgctgcaataacaaggcccagagcattggatagagttgatgcgtacgaggtctgccggtggcagcgtggaaatgagaaacgaaggagaccgggacaatttcatcgaggtcaatggtatgagagagaagttcaaggaactcatatttatcgttgttgaatttattttggcaatcagagaaaatatctgccaaagaaagctgtttgtatgttatcatagtattatgcaactcctttcaggaggatggttgattgtttttaggcaattcaattttaccataaaccagtgaggagttgttttatttttgcaataaaaaacaccgtaattatgcgggtttcggcgtttcgcaaatgcctatatggtatgatagcagaaaggagtgatacaaatgatgcatgtattttattgtataaaatgcaaaagataccattacaccaacaatcagtcgcacgcaaactgctgtggagagcaaatgtattatgtagacgtggatttcacagaatttgtcagaatgaaccgggaagagcgtgcaaacttcttacagctttattctctcgcagaataaggctgtgtttctgcatatttacatcaattttgcacacactatcataaaaagtgtaaggaggttgtaatatgagagaaatcaaaatgccctcaaagacagctgaagaaaatgaatacgatgaccataacattcccgaaattgatctgccgggaaaagcaagcgtaggaaacatcatccccgatgaggttccgcggcgcgacggggattaagtaaggggacgctaagtaaagcaggaggcacccagccacttcaatccgccgcccccgcccagaatccccaccggtaaattcatacccccggccggatgcaagcagccgccggaaccggagataggtgtggctggaggcgtagcagcggttgtaagctggagtaaagtaaaatagaaggaaaaccggggcaaaaaatgtaatctccaaattacattttttcctgggcccagcgcgcgaacccatcaggggttcgggtgatgtgcccaggctgccccggttttccttctattttactttactccagcttacagccgcagccccgtctccagccacacctatctccggttccggcggcggactatacttcccccctgcaagaattcaccccaattccgcgatacgtgatactcctacgtagatttctgatattttataccaagttctatagtccacggttcccgtctgcggaaggccgaacacggactggaatttttctacagttgcggccgttgccggaccgtatattccgtctgcagcgattttggggatggcgggatatgccccggctatgacgttgagctgttcctgcatctgcctgactttgtcgccgctggaaccgatctccaggatgtagcccggccaggaggacgggactccggatatttcctgggcagtgttgatatacatatcatctccgtaataataacgcagaatctcgatcgggctatagccctgttccccgagtgccatagagccccactgtgtcatccagtttggacaggttaccctgcgcccatcacagtactgtgtcaggatcggctgccttacattcggcctggacagataatccgcaaacaactcatccacgattaccgagattgtatcaaaaaaatttctctccgggatccatttgtggtcaaatgctgtggaggatgtaattgtaaaatcatatcctttattgcggtaccattctgtgtacacgcggtttagagtaaaagacataatggccaggacatttgcccggattgtatctgccggccatgtggcgtagatttcactggatgccacatttttgatataatctttatattttacataataattctgtgcggtagtatcccgtggagaaccgtcatgcacaattataaattccggcactactaccctgctcagaacgatttcgccggtctcgtttatcggctttatttcgtcctccgctatcttcggaggatattcaccgtataatgtatgtgcaggtattacaaaaacctgttcattcacacccgtctggtcattcggcctaagcgccacattctgtattgctcttacatccggcagaatctctgtccccgcaatgctcataggttcaaaacccggtgcactgatatccagtgtgtattcggagtaaggctggtactcaattgtaggattcaggctgtactccaggggcggagcatccagatccagtatatccgtctgtccggatgaatccgtgttcacctgctccagtgtactctccggaactccggtataagatatcgatattgtcgccccagtaacaggaagtgctgtgatctctgatgtaacgttaatctgcagctggcctttgtctacagcattattctgcattgctcttaaagaagtcatatattccctcgcaaaaaattcatctctattatatatatgcaccggaatttaaaatgtgcctgcgggccaaacagggaaattaccgtcaattcaaatacgcccctgaaaagacacccgctgtttaccgcacgtatcttctccgaggcgtccacacttatctcgtcaaaaaatattccgtatatcattgaaaagaactacgaccataagaaccatcagcagtgcaaagcctgcaaagtgcaccatcccttctttttccgggggcacacgcttccggcgtacggcctcgacgatcaaaaaaaccaatctgccgccgtccagcgccggaatcggcagcaggttcatcactcccaggttggccgacagcagaatggcaatgttaagcagattcaagattaccgttacggcccccgacggagccgcctgcttgtatgtgtcatccacaaaattcacaatccccacaggccctgacatctgtttgattccgatctgcccggtaacaagcatcctgaggcagtcaaacgtataatttacccagtaccgcagcgtgtatgccccatatttaacagagtctaccagcccggcctttgtgttggccgtgctgccacggattcccaaccgtttcatgctgtccccctcaagctgcctgggtacaatcgtggccgtatactcctgcccgtctctttcgtatgtgacctccacggaatctgcatcgctgttcatcatattaaagaggctgacctctctccatagatgaatatcctttccattcagtcccgtaatgacatcgccctcctgcagtccctgctccatggctgaatatcctgcatccaccccctggactaccggagcatcatacccgatccaggccaccagaatgactgaaaatatcaaagccataataaagttgaacaccgggcctgccgcaatcacagatatccttgcccagacagacttgctgttaaagctgccctccgacagatcatccgcatcatcttcccccatcatacatgccccgccaaatggcagaagcttcagagaaaactttgtccccccgaattcttttcctatgattgtaggaccaagtcccaacgaaaattcgtccacgcgtatgccattaagcttcgccaaggtaaaatgtcccagctcatggaatataataaccacgctgaacagaagtattgctaaaattatccccatatactaccacctgttttttataaattcatatgttgcctgctccgtatttagtatctcttccactgtaggatgttcaattattttatgtttctccatacaagcctgtatcatctccggaatctgcaggtaacggatcttcctttccagaaagagggctacggccttttcattggctgcattgaagacagtaggcagggatcccccccgccttccggcctcgtatgccagcttcaggccataaaatgtttccatatctggtttctcaaatgtaatctgtgacagcgccccaaagtccagcctgccgcccggaagatatcttctctccggataatacagggcgtactgaatcggaagcttcatatccggtgtcccaagttcagcgataacagctccgtcctcgtactcaaccatagaatggataatgctctgcggctgcacgactacttcaacctggtctaccgttacatcaaaaagccacttcgcctcgatgacctccaggcccttgttgaccattgtggaggaatcgatcgtgatcttgcgccccatctcccagttcggatgcttcagggcgtcttccacctgaatgttctcaagctccgtttttgaacggcccctgaagggccctccggaggccgtcagcagtatcttgtggagagcggccctctgtccgccctgcagggactgaaaaatggcgctgtgctcgctgtccacgggcaggattgacactccatattccctggccagcggcatgatgatatgccctgccgtgacaagtgtttccttattggcaagcgcaatatccttcttcgcacgtatcgcctcaatcgtaggcagtatcccgatcataccgacaacggccgttaccagaatctccgattctggctctgccgctgtttccaggattccttccattcccgccgttacttttacatccagatcccggatatgcgctttcagttcctttgctttttcctctgaccacactgctgccatcttaggatgaaactcccggatctgcttctccagcagtgcaatgttgctgcccgcagccagtgcggttacttctatatcgccattctcacgcacgacttccaatgtctgggtcccgatagaacctgtggagcccagtattgcaattttcttcatatgcagctccttcctttatcatcatttgttcaggactataagcagatacactgcagggcaataaaaaccaccacaaatgatggacgtgccaacgaatgtttcctgtttcagaacagtcctgtaccaaagagttactctttcccctaaagaagaaccgccaggtaatatatgataggtgccgtaaatatcacactgtcgaatctgtcaagtatcccgccatgccccggaatcagctttccataatcttttatattgtggttgcgcttgattgcggaagccgccagatcacccacctgtgagatcgcgcctcccgctgcgccaatgattgcaaacctgacaatgcctgcgcccgcattcccccacttgttgattgcaagggcataaagcacgcccagaagtgcggctcctgcgatcccgcctatgccgccctccactgactttttgggactcagcttcggagccatcttatgttttccgatcagcatgcccacgcaataggcacaggtatcgcatccccaggagcagatgaacacaagccatacagtaaataccccgcccggcaagatgcggatctggtaaatataggacagcatcacagccacataaaatacaccgaaaaatgctgccagtatctgctctgtcttgtatttgggaaaggagaatacaagtactcccatcatacagattaaaaatgccatgaacaaaagcataaaccagtctgtcccagccggcagaaccggcttcaaatagatcagcgcataataggcggccgcaaagaggtagccgcagattcccggagccttgttacggatatcaaagactttgtaaagttcgctcaggccgatcatgctgatgattagcagcactaaaaacagaatgcttccgccggaaatcactgtaaatagtgcaatgagtactaatagtattccactgagtagccgtgtcttaaacatcctgttcctcctttacgcccccgtaacgtctgtctctgctattatactgctcgacagcttttaccaattcctcttttgtaaaatccggccataaaacatctgtaaaataaaattccgtataggccatctgccagagaagataattggaaagcctctgctcaccgctcgtccggatcaaaagatccggatccggaatcccatgtgtatccagatacgactcatagaccgggtcactgatctcatccacacatatcttcccatccacacaatcctgcgccagacatttgactgcccttatcatctcatccctgctgccataattaatggcaattgtgaagttcaggccattgttgtctttgctggcttcctccagttctattatcctgttcttaatatcttcatccagcgcttttatatccccgattacacggattttcatatcatttttctcagccgtcttcagacaggtcttcatgtaattgcggagcagcttcatcagcgcatctacttcgctcttcggccggttccagttttccgtggaaaatgcataaacggtcaagtattttattcccatccgccatgcctcctcgcaaattctttccacatttttgcttccctgcgcatgtccgtaatttctcggcattccttttgactttgcccaccggccgttgccgtccagtatgattgctacatgctgtggtacgttcattctaaatatcctcctaataccgacaattttatcgcatgccttatatcagcaaaagagaggctgcatacgagcccctcttgtttacaagttaacctacccgctaaactgtaagcacttctttggattttgcttccacacagctgtccacttttgcaatgaatttatcggtcatcttctgaagggatgcttccagatctttgatgccgtcctcagaaatctctccgcctttgagcttcttgaaagcttcgtttccgtcgcggcggatattgcggactgcaactttcgccgcctcaccctttttcttaacgtccttaaccagctcttttcttcgctcttccgttagttccggaaataccaggcggatggtgctgccgtcgttcgtcggattgatcccgatatctgacatattgattgctttctctacctctttgagcaggctcttttcccagggctgaatctgaatcaggcgcgcctcgggtacagagatgttcgccacctgctgaatcggtgtaggggagccataataatcaacggtcagcttgtccagtacatgcggattggcacgtcctgccctgatggttgccagttcactgttcaggttgtctacggtcttcgtcatcttttcttcatatttttttaatttttcatccatgtcaattgtcctccttatactgttacttttgtgccggtaaatgtcccgctcatcgtctctgcgatactgttctcttcattcagtccgaatacaagcatcggcatcttattctccatacacaggatggatgctgtcaggtctactgccgcaagcttctggtcaataacctcctgaatcgaaatctcttcatacttctttgcctccgggttcaccttcggatcgctgtcatagatcccgtcgattgccttcgcaagaagcatagcatctgcttctatctcgattgcccgaagcaccgcccctgtatccgtcgaaaaatacggatggcctgtgccgccggcaaaaaagataaccttaccttcttccagggccgcgactgccgcatccttggaaaataatgtggtaaatgccccacatacaaacggggtaaagatctctgtcttcattcccacatgtctgaatatatcggatacataaatacagttcataaccgttgccagcatcccaatctgatctgcctttgtccggtctattgtctcgctggtgcggcccctccagaaattgcctcctccggtcactaccgcgacctgaattccttcgtccacaagctgtctgacctgttctgccacaccaatgcaggtagcctcgtcaaacccggtcttcttatctcctgcaagtgcttcaccactcagctttaacaatactcttttcatacgtttttagctccttcaaattctgttgattactctaaaatgaagtataacataacttttccattttgtcatgcacatatccggcatctctttcatctgtcatcgtagtcagtgtatcccctgccattaacatggtccgcccctttggaatccgctcttttccgcccctttccagggcaacgagaaggcagttgtcgggccaggtaatctcctccacgcttttgccttccagcacggaaccgttcatgatcacaaaggtgctaagcaccttctgtcccgggcttttcatattctgagtctggttttttccggaagtatacaaaatacggtccagcatactttcatagattggttccgacttcatcagcgtagcgacgatataagcagtaaccgaaacgattgccagggaaagcatctggcttacggaacctgacatttcaaacagaaggatgataccggttatcggagcccgcacaatcgccgtaaaatatccagccatggccagcaggacaaaattattgatatacatttcctccagtccgaagaattcaacgcctgtcatggcaaaaacaccgccgatcatggctcccaatatcagaagcgggaaaaagatccctcccggggccccggatccgaaactgactgcagagaaaagaaattttacaacaaaggtcacgatgaccagactgagcgccatttccccgtttgttaatgtgatgatcagtttgtggccgctgcccagcacggacggcattacaagtcccaggattcctgctgccagaaaggcaatcatcagcctggaagtctcatttaaaaactttggctttttatacaaatcctgggctttcagcatgacccagttatagaagactcccatcacaccgcagaccgctcccaaaagaatcagcatccagtaataattctgcggaagatagtgttcgagctgcaatttaaaaaccggatccagaccgaggatatgggaggatataaagtccgacgttacggatgctgtcatgacggaaatcagtatggacatggaaaaacctttatgtatctcctccagagcgaacatcatgcccgcgagaggtgcgtggaaagccgcggcaaggcctgcgctggccccgcatgtcataagaaacctttcctccgtcttaccccggtcgagcatcctggacagtccctgtcctgccatcgccccgagctggatggaggggccttctcttcccagcgataatccgccgaacaggcagagaaaaccgccagcaaacttggcaggcagcacctttttccaattctgcgttagttttccggttacttccccttccacctgggggataccgctcccggatatcattggcgcccattttaccagtctgccaaccacatatgccatcagaagcaggattatgaaccatcctgcgatccgaatggggttgcccctgatatatttgagcacaatatccagccactttcccgcatacgtcagtgcaacccggtacaacaacaccagcagacctcccactgcacctacaagaaggccctctccgatcaggataaccggaaagcgctgtgcccgtttaatggtatgtgtagtatcctttttcaatgtttttccctcttttcctctcattgaggtgcgcccccgcagcacccgctttataaaactctaaatgaacatggaaaacaaaaccgtcaccactccgcagattccaatggcgaggccactcatagccccttctacttcaccgatctcaattgccttggatgtccccaccgcatggctgcaggcgccgatggcaaggcctgccgctacggaatccgatactttaaaaatccgtataagcagcggcgcggcaatgctccctaatatccctgtgaaaattaccgccacgaccgttacgggtacgacgccgccgtgtgcctgcgcaacgctcacagcgatcggtgtggtaacggatttgggaagcatggacatggtcaggctctgatccagtctgaacagtctgcacattccgtacacgctggccatggacgccagagaacctgctatacatcctactataataggaagccagtattttttcaagatggaaagcttcgtaaagatagatactgcaaggcaggccgttgccggagccaggaacatattaatgatttctccgcctttattataggaatcatatggtattttaaaaacaaggagcacgcctataataagaacgattgcaataataagaggattacagagaggcgattttgttttctgctgaatcctgactcctgcgccgaaagcaattacgctgagagccactccaaagtagggagatgtatacaaagcttccattattttttcctccgatctattaatttcatggtcagcttcacactgtatgccgtcaccgcaaacgtgatgactgtagatacgatacagataatcagcagctgtaccgcactgcttttgagaatgtcaaaataattcatgatgctcacccctgccggtacaaagaaaaaggccatattcccaagaagaaagtccgacttttcctggatatgttctatcttcagcatgcctgtcagcagacagataaataagaatatcattcctatgacgcttgccggaaaatcaaagggcagaaactcagcgatcacctggctcagccagcagacagtaaaaatgattccaatttgcctgattattttcataataatatccctcaattcttttatgttttatatctagatccatatggctatcttccaaaatacacccgctggtttctgttgtcaacggaatgggccaggattgctgatttctcttatactattttccccaaacttattgacattaagcccgggatgttttatgatacttatgttttcacactttaaacagttaaaattttacagtgcgaagtcattgtaaatgggaggtaatagaatgattattgtattaaaaccacacacatcggaaggtaatatcgaccgggtggaaggccttgttaaaaagcgcggactggatacccacattgtcagaggacaggaaatgacgatcattggctgtattggggatactacagcgattgatcccaaattatttgaagtcgatgactgcgtggataaagtcatgcatgtccaggaaccttacaaacttgcaaaccgggcattccacccggaggattccatcattgatgtctccggcgtgaagatcggcgggaaccacctagcccttatagccggcccctgctccgtagaatcttttgctcaggtgatggacatagccaaatccgcaaaggcctccggtgccaacctgctgcgcggcggtgcatttaagccccgtacaagtccatattctttccagggactcggcatggagggcctggatatcctctgtgaggtcaagaaagaaacagggcttcctattgtaacggaattaatgtcccctgaatacctggagattttcaacgagaaagtagatttaatccaaatcggcgccagaaatatgcagaatttcgatctgctcaagcagctcggacagctggaccgccccatccttctaaagcggggcctcaatgcaacatacgaggaatggatcatgtccgccgaatacattatggcatccggtaacgagaacgttattctctgcgaacgtggaatccgaacctttgagacattcacaagaaatacgctcgatcttcagagtatacctgttctgaagaaaaaaacacatctgcctgtcatcgtagacccgagccatgcaggcggaaaatggtggctggtagagccaatggcaaaagcgtctgttgctgcgggtgctgacggactaatgatcgaggttcataacgatcccgaatccgctttatgtgacggggctcagtcactgaaaccgaaaaaatataacgatttgttaaaacaaattaaagaaatagctctggtagtcggaaaagaagtataggagcgcaagggggtcagacccctctgcagaggggtctgacccccttgcgtaccattttgtctaaaaaggagaaatctcgtggaattaacagtaaacttaggtgaaaacagctatccaatctatatagaatccggaattctagcaaatgcagaaacttttgtagcacaagtctttcatggaaaacgcattatgattatttctgatgatcatgtttttcctatttacggccagaaactggtaaaggcacttccgtcctatgaatgccacagcctcgtacttccacacggggagctgacgaagagttttcagtctctcccccggatttatgccgctatgctggaaagtaacattacccgcagtgatctcgtcattgcactggggggcggtgtcataggtgatctggccggttttgctgccgcaagttatctgcgcggtgtgaagctggttcagataccaacctctcttctggctcaggtagactcctccgtggggggaaaggtagcggttgatcttccacagggaaagaatctggcaggtgcattttttcatcccaagctggtgctgatagatcccgacgtgctggatacccttcccaaacggtatatcactgacggcatgggggaagtgatcaagtatggctgtattaaggatgccagcctctttgaaaccttaagttccactccttcgtttgatggattaaaagacaggctgtcctcaatcatataccgctgtgtagatatcaaaagaatcgttgtggaaggcgaccagtttgacactggtgagcggatgctgctgaatttcggccatactctggcacatacgatcgagcagtattatcactatgaacgcgaaagccatggtgaagccgttgcaattggcatgtaccagatgacaaagatttccgaaaaggccgggcttactgtccccggcgaagcagaacgaatcaaacaggtgctggatacctacggtctcccctgtgaatgcggacttccggtgtccgcactcctggatgctgtcaggctggacaaaaagaatctggataatcatctaaatgtaattcttttacacgctattggtgacagctttatttaccctaccaatctcgatttttttggaatagcaggagtgatttaaccatgaatacagaaaagaaggaacctctgcattttggtgtactgggtaaccagcttggacacagcctttctcctgagatccacgaagatctgcttcggcagcagaagatctccggtacgtataaaaaatatgaaatgaacgaaaacgaagtcccccgtatactggaagtaatgagggacgaacatattctgggcatgaatgtaacaatgccatataaagaagtcgtttatcaactcgtggatgtccttgatccacatgcagaaaaaataggcgctgtcaatactgttttaatgaaagacggtaaattttacggttacaatacagattatatcggggccgtcagcatgttccacaaagccggcatcacactggctgggaaagaaattgtcattctcggttcgggcggggcggcccgggggctgatctatggattccatacggatggcgccgctaaaattacagtcgcagcacgtaacgaaaaagcgctcgattatctgcaagaacgttttccttatattaaaacctgtaaactgacaaatgttcctgccggtgatattctggtcaacaccactcccctgggcatgcatccccacgttggcgaaagtccggtagatgcagccgtaatccggcagtttaaagcagcctccgacattgtctataatcctttgattacggaatttttaagaattgcaaaagaagaaggactgcagatcgtaaccggactcatgatgctggtagaccaggcaatcggatctgaagaaatctggctgggtaaaaagctggattataatatgggcaatcggatacacgatgaattagccagaaaattctgacaatggtgttcaaaagggtcagacccctctgcagaggggtctgacccctttacgcaatttcccatggattttctttccctgcctcattcagacaacagctttctatggaatgtctcaccatatcactcactgcctgatccgtataaaacgccatgtgaggtgttacgatcacattagggaatccccgcagtatatataactccctcttacttataatatcggattttcggtcataataatacatcccaaattcatcttcaatcacatccattgcagccgcaccaatcttctctgactccagaccgtccagcaacgcttttgtatcgatcagaccaccccgggccgtgttaatcaggactaccccctgtttcattttagcaatggcatctgcgttgatcatatggtaattgtcatccccaaggggcatatggagtgttatcatatcacatgtttcaaagatcgtatcaagttccgcgtattctgcatatgctttgaccttttgggatggaaacaggtcataagcataaatctggcatccaaatccactcagatcgcggattacggcctgcccaatctttccggtgcctatcacacccacggtaaaattgtgcatctcatgtccctgtatgcccggaagggaaaaatcattgatctccgctctctgcatgatccgtttcattttacggatcgccataagcatgagcatgaccgtgtaatccgccacacactcaggcgagtacgttacattgctaactttgattccaaatttctgcgctgcctccagatccacatggtcataccctattgtcctggttgatatcatctttacccccagctcgtggaaacgcttgattagctgtgcatccatcttggtggtaataatactgatatattcatatcccttggcaagactggcattttccatgcaggggtcatcataacagatccccagctccacgccgtattctttggaaaatctctgaaaatatacagcctcatcgaactcccggtaattataaacaaatatcttcatcacaaaacctccctgcaagagcgtactttacatcaggccatagtggctgaatgcacgggctatcccgtcctcctccaccttagccgttacatattcggtgtacgggtcaagttcttttgcatgatctcccatagctatcgcatgccccgcatattcgaacattgataaatcattcgagctatccccaaatacatatgcctgctcagtctctattgcaaacttcttcaaaatatactcacacgcggttgctttagaatagcccttctgaatgcactcataagtatcgccgccccggttgatcggctcgatatctttctccacaaacttgaaaaaagtgtctttgtcgctgagttcatccgcataaacaaacaatttgtcatacacaaagcttcccttttcaatatactcctccaggcccagcccggcgttctgaaaatatcgtctggagctctccagcctgtcaaaacgcgacattctgcttggcagatatatgtcctgagtcccctccataatcccatccagcctgcattctatcattttatcaataatctctcttccccgcctttcgggaattgatctggaaaataaaacctcgtcatgataagtgagatatgtcccgcatccacacaggaatccatcaaattcaaactggctgatcttcggcggtatactgcagaatgtccgccctgtatttataaaaagcaggtgtcccgcacgctttgccgcacgcatggcatccagcgcgctctgcgggatctccttcgtaatctcactcagtatggtgccatcaatatccaaaaacagtgctgctctttccatctttttctcctaacgtttcagattttcttctatcactttatcactctttccccgaaaaatccatttctatacctcacaaaaaaataagatttctccctgcagcttccgctgatttgccatatgatgaaaatatttctgcattttcatcatatactataggaaataagatacaggagatgtaatgagaatcaatctaaaacccgatacgaaaaagaaagctcttctaaaaaacactgccagactcgctctgctccttgctgttgcatttttggccggacgcgccgccggaagggctcaggattattttgccccccaggctgttgccacctccgcagaagggaactggggattaagcttccaggacgagggccagccgccggtcgctaatgcaaccgccgaagagctgaaacaatttgacgcatactattccggaaatacggatgaaaaggtcatatacctgacctttgacgcgggattcgaaaatggcaacacccctgcgattctagatgcgctgaaaaaacacaatgtacctgcgacattctttgtagtaggcaccttcatatcgtccaatccggatctgattaaaaggatggtggaagagggccatacggtgggcaaccatacatatcaccatcccgatatgtcacagatatcaacccaggaagccttccaaaaagaactgggagatgttgaagaggaatataagaaaattaccggtcaggacatgacgaaatactatcgtcctccgcaaggaaaatacagtgaaacaaacctgaagatggcaaaagaaatggggtataaaacctttttctggagcctggcctatgtagactggtatgaaaatgaccaacccacaaaagagacggctttcgaaaaactgcttggcaggatccaccccggtgcaatcgtactgcttcacagtacctcaaaaacaaacggcgaaatactcgatgaactgctgacaaaatgggaggaaatggggtatacatttaaaccactgtcggaaatttaaggagatgggccgcctatcgaaacatggagcaggaagatacagggagacaggagtgtttctatggacggaccctttgtgaagaaactcttacagcaagacagaagaatcttatgactatagacagatttacggaaaaagcttgatgctttctcggctcagccgtctcaaatctttattttgtgaatcaagatttggccataagattcttctgtttttctgtaagaatttctaatcacacgctttatgcccacagaaacacccctgtcacccttctgtcctgcgttccttcggcccattcggctatcttgccttaaattcctccacaatatgtatcatttcctctgatggattggatattactgctgagttaagtatcttacacggtgaatttacagctgcgctctctactgccgcagttactgcagaaacactgccactgataaatatgagggcatgtcctccgcattttgtgtcctgtgtctcataggttacttctgccgctttcagcatctgatccgtgaccagtacggcgtttgcttccccaaggacttctacaagtccgaatgctccatatgccataaaaatatacctcttccctacttgttgattgtcattgtaattgctggttcagtctcagctaacggtgctgctattatcgtatgggatacaatcttggagattggttccgctgctctgagcgcaacttccatggctgcattgacgttggagacattgcctctcatctttacacatgcacccgctcccagacgatttctctctactgcctggatctttacatccgcagcttttgctgccgcatctaatgctacaaaacatgcgcactcactgtcgagctcgaatacgcctattgccataccttcatactgtccggccataattccctcctgcctgcagaactactattttttctattctgtcaatatttttattatatataaccaaagataaaatttcaacaaaaaagtggagaatctttagttactatgcgcggcctatggtcgtgaataataacaatctttaccatttctccaccttatttattttataaaaataatacggaaccaaagggattagtgccgcaagccaggccgccgggtctgaaaggcagaccccgaagaagctcgtctttccggcaaccgctgctacaaccagggcgcgcgcagccagttcaaacaccccgcccagcataggcaccaggccgtatcccattccctgcagtgcattgcggtacaaaaagatgcttccaaggaacggatagcaccagaataccgccaggaaataaaccacagcagcatcaattacacctttctccgcaggggaaacaaacataagcaccatgtattttccaaagaaaaatatcaataccatcagtaccgcgctgcagattaagatcatcgcctgtgtataccaaacgccctttttcaccctgtctaacctgcctcccccccagttctgccctacataggttgcaatggttgcgccgaatgctataaagacacatgcgatcaggttctggatcttggctccggcggaaaagcctgcaatatagactgccccgtaaatgttaaccgcaccctgtacaatgatcgttccaatcccggtgatggaaaactgcaggcccatcggtgttcccagcgccagaagtttttttatactgttccaggaaatatggaaatcctcttttttcagatgcagaatcaaaaatttctttttgatatacaaaaaacacagcagcgctgagattccctgcgcgatcactgttgcatagccgcaccctgttacacccatgtgaaaccaggtgataaatacaatatccagaaagatattaatcactgcggaaatgatcaaaaaatacagcggtgatttggaattccccagtgccctgagcacggcagccagagaattataagcggccgtcacgatcaggcctgcatagataactgtcatatagcctttcacatccggcatcagttcttccggtgtattcatgagcctgagtatcggctcatttgctgccaaaagccccactgtcataactacaataatgacaaatgtcagatagaccgacatggctgtataatgccgcatccggtcgtatttgcgggcaccaaaccattgtgccactaaaatagaaaaaccactgctgattccggtgatccagccggtcaccataaacatgagtgaacctgtgctcccaatggcggcaagggcattcacccctaggaactgccctgctataatcgaatccgcaatattataaaactgctgaaatatatttcccaggcacatcgggatcataaaccagattaccagcattaccgggtttcctgtggtcatatcgtttgtcttattctttcccatttatctcttctgcagcatcgctgccttcctctttttttataccggtcttttatttcctatggccggactttcctgctaagataaaatacggctgtactctcgtgctgccttactgccaggcacgtttgtacagccagatattttataaatctatgctgatttcctgtttttcgatattatgcttcttggcatagccggtcaggatcatggtcagcgcaccgtccccggtcacattgcatgcggttccaaagctgtcctgcagggcaaatatcgtaagcatcagcgcggttccggtctcatcaaatccaagcaccccggtaatcagccccagtgaagccattacggtgccgcccggaaccccgggagccccgattgcaaagattcccagcagcacacagaacagtatcattgttcccggtgaaggaatgctgccgtagaggattttggatactgtcatgacaaaaaatacttccgtcagtacagaaccgcagagatggatatttgcaaacagcgggatcccaaaatcaaccatatcctctctgagaggcggctctgattttttcgcacaccgcagggcaaccgccagagtcgctgcagaagacatcgttccgaccgcggtaatatatgccgggccataattcttgatgacatccagcgggttactcttcgaataagcaccgcctgctgcatagagcacagccagccagatatagtgtcctgccataacgatcagtacgactttaataaataccggcagctgttttgtgattgtaccttcataggacaatgcacagaatgtaaaggcgataaagattggaagtaccggaatcacgactttggtcacgatctccagtacgattttctggaattcatccagtacttgtgtaatcacttttgcttttgtccacgcagccgcaagtccgatcataacggaaaataccagtgcgctcatgaccggcatgatctgcggaatatccagctggaatactacaccgggaagttcttttagcccatccacctcggatacgatggagaggtgcgggatcaggccgtaacctgccagcatggaaagaagcgctgccagcacggaggacacataggcgataacgattgccacacccagcatcctggaggcattgttgcccagcttcgtaatggatggggcaataaagccgatgataatcagcggaacacagaatgtgatcaactgtccgagaatgtattttacagtgactacaatattcataaatccctcattggcaatctggccaatcaggataccagccaccactccgagcagcagccggaatggcagattattaaataatttcttcatagtttcaatccctttcctatagaatcgctatattataacatctctctctttctctccgcaaacatccgcctgcagttcctgtatttaccagccgtctgatggctatggctcaatatcttccggctctatgctgaatcaactgagccgtgatgctcaccgcaatctccgcaggcgtttctgctccgatggcaaggccgatcggagtcgtgattctgtccagatctgcatccgtaaacccctgttcttttaattttgcaaacacaccggcttttttatgtctgctcccgatcactccgatataagctgcggaagtctttaaaacctgtgcctgaaccgccagatcgtccttatgcccgcgggtcatgatacacacataatccagggcatcgattgtaacataatctgcaatatggctgttctcaattaacaggacctcttctgccccgggaaataattcagccctgctgaactcctccctgtcctccagaactacacacctgaaatcaactgctgctagagccggcaccagcgcctgtgaaacgtgtcctcccccgaaaatatagacacgctcctgctgctgcatattctcacagtaaaacttacgcccctgtgcttctatctgcacgggtttcttctgcagaccttcaagaacagccgctggaagtgatatccctgcgatagctccagaacggcggcagaccgccatacctccctctccgtcctcagaaatctcgctgacaagccagaattcttcttttgtttgatataatgccccaatctgcctaaatagaaccagtttctgctcatcacctgcagaaatgtattgaaactgcacattcacatcccccccgcagatcattcccaggtcctggatctcattttccctgagccggaagtattccaagcgcggcttcttgctgcgcagtacctctgccgccacgtcttcactgcggtgctcgaccgccccgccgcctaccgtcccccagattctgccggcggaagtaaccagcatacgcgcccccgccccccgcggggtggagccggagcttgcaacaaccgtgaccagaaccgcatcctgcccctttaacatacactcatacagtaagtgaaataatttctccatgccatcatcctttcataggggtcagacccctataataattgcgccctcagttcttctgctgttttcatggaaagcatacccggtgcgatatcgaatactgtctttgcaccggaatctccatttttagagagacggtatgccgcacgcgcgtagcataccagtacgctggatgtaaattccggattggaatccagcttcagtgagtattcaattacgtgcttactgccttctcttcccgtctcaccactgcggatgacaaatccaccgtgcggcattttgctgtgttcggctttcagttgttcttctgtgataaaagttacggttgtgttgtaatccgagaagtagttcggcatgtttttgattgtttcttcgatctccttcagatccgcgccttcctcagccactacataacattctcttaagtgtttgtctcttgtagtgagtttgggaccgcacccgcttcttacctgctctacagcttcttcaaccggcacggtatactggatggcgttcttcacacccttcacgcggcggatcgcgtctgaatgtccctggcttacgccttttccccagaatgtatatgtatctccctgtacaaggatggactccgcatagatcctgttcagtgaaaacatccccggatcccagcctacggaaatgattccgatatggccgccggcttttgcggatgcgtctacatttgcaaaatattccggtatcttggcatgagtgtcaaaactgtcgatcgtgttgaagttctttacaatctcaggtccgattaccggcaggtccgttgctgagccgccgcacaggatcataacatcaatctcatctttcatgctaagtatatcatccatatgaacgaccggaacaccctctgtcataatctgaacgctctcgggttcacgccgtgtaaagatggcttttaattccatatcctcattgcgctcaaccgcaagctctactccacgtccgatgtttccataaccaacaattccaattttgattttctccatcgtatatccttcctctccaatatttctttcttaaattttttgaatcgttaataagtataacatatgaatcctgcgtgtacaatttaaaattaaagcgcacccaggcatattaaccgcggatgcgctctgtgttttcctctttaaacttattcgctgcttctaaaacggaatctccggtacatcaaaaatcaaatattcggactcatgccccaccatgtcacagcttctcgatccctgttgcaaaatatcctgccgatcggacggcttctttcagttgactgtcttcgcactccttcttcattctgaccgttacgcacccctctgcaaaatcagccttagctaatacgccatccatactgttaaaaacattttccactcttttagcacaatttgtgcaggtcattccctcgatccgtatttttctgatgtacggatagtgggcaatatttttatccgcaggcctcacgcgtttcaccggatcatggccgctcccgcagcacccgtgcgtcaaacgctttgtatagcttctgatccccaacacacaaacgataataatcatgatacatataattccagttgccataatactttactcctgtctgatcttgttttagtaattcatctctcttcctatagaggcgggagaatttccacatcttgtgaaacattcaataggaggagacacacgccatgagttcattatgctctcttcttctcagttagtcctccctaactatataatacaacataattgcaaaaaagaaaacccctttatattttttctgctttagatcataaatcaaaatgaattctatcttaggcagttacatctgtgaatgcgccgattcatacctttgtcactttcctgtcacttttcttttttaatatggtatcatcaaacatgaaaggagttattaacttatggaaattttacgctgcagccatcttacaaaaacatatggcagtggttccaatacggtaacagcattggacgatgtctcgctttcgcttgaacggggcagctttacggctattgtcggtgcgtccggttccgggaaatccactctgctgcatatgctgggaggcgtagaccgccctaccagtggcagcatttttatcgaagacacagacatttcaacactcagtatggaggaacttgcggttttccggcgcagaaaggtagggctggtctatcagttttataatctgatcccaacactgaacgtaaggaaaaacattctcctgcctgttcttttagataatcagaagccggatgaggagcggtttcgccatctggtttccaccctggggcttacagaccgtctcgcacaccttcccagtgaattatcaggaggccagcagcagcgcaccgctatcgcaagaagcctcatctaccatccggcgatccttcttgccgatgaaccaactggcaatctggaccgtaaaaattcagaagaaaccatcgagcttctgaagctctctaaccggcagtacggacagtctgtcctcctgattacacacgatgaaaagaccgctctaaaggcagaccgcgtaattactctggaggatgggaaaattctgcatgacgaggtggtgtcctgatgaaaattttacgagaatatgtttgggacacgatacgaagaaataagagaaccagcattgccatcatgaccgcattatttcttatgaccacgatgatgtcctgtttctgcggttttgtctacacaatgtggacagatgccattgtcctcacgaaactcgaagacggggactggcacggagaattgttcgatacaacgtacggaaaggatcttgaacacattgagaactacgcctctgtctctgccgttctggtcaaaggcccgtgggaagccgcgaagctggaagaggagggacgcaggacatacctcattacccgcggcgccaaccaggaatactgggattctatgccggaaaaggatactctgaccgaaggcaggctcccgcaagccgccaatgagcttgtactttcaaaacagtattttgatgaccaccccggcacaaaagtgggcgataccctcacgcttccgatcgggcagcgcatgtatcaagggaaggtatgcatggaaacagacggatatcacgaggatgagaccttccgtcaaacaggtacaaagacatacaaaattgtaggaattcttgatgttaccacatcctcctccgtaccagcctatactggaatgagttatctggatacaaagactgtgaacccggccgatgagctaacggtctatcttcgttttgaccccatgaggagtacttataaggagctcccggaactggcgcgctccttaggctaccaggccgatgaatacggagactatacgctcagatataatgcaggcctgctctcaaaatacgggatactctcgccggatcaaatcggaagcatcagcagcctctctgttcttgccgtacctgccatgtttctggtcattgcgcttctgctgatcgccgtatttgtactggtcatccacaatgcttttgccctttctgccagcgaaaaactggtgcagctcggaaccctggccggtattggcgcatcccccaaacagatcaaggcggcggtgacatccgaggcaatgatcctgctgattgtgcctctccctgtcggaatattatgcggctggctgctggatacagagttgttccgtctgattaatgctgcaaataatatcggcagaaccgcgccggatattgtacttacattcgggcttcccgccatacttcctgcaattctcctgtccgctgccacagcctggctttcggcgagaataccggcccgcagagttgcaaaactgatgcctgtagaggccctgaggcaggtggaggtgctgaaaggaaaaaagatccggcagggacgcatatccagccattttggaatcagcggtgaactggcttccaacgccctcactgcccgtaaaaaatcgtaccgggccgcaacgatttccctttgtctatctttccttctgctcaccggatttttatatattattactacccaaaatgcatcgaaagaggtttacagggcgcagaatgaatcccagggccatgtctttttcagcatcagcgatggccggcagcccgaacagaaggcgttagatgaggttttaaaagtgcccggtgtctccaggggaataatcatgaataaaatgccttgtgctacctggattacagaagatcagacttcagatgatatcgagacatatctgggcggatttgatgagataatttctgagaaaaagtactctcccattgaaagggatggaaaatacaggatttattctatacttattggcctggaggaggacagtttcagagaatactgcaaagaaatggggacagatcctgattcctactataaagatcctgcaaaggcgctgatctataaccgtaccgaagaccctgaggtaagtacccgtaagcagggtgtctaccgggatatcctgaaacttcagccgggacagaccctcacttttacagaaaaggcctatgatgaggacaccggtaactttgaattccgtctgaccgcaggggatctggtaactgaactccccgccgaaggcatcggcctgccgcgtttttccttagccgctgttatgcctatggaacatgtactggatatctccgcgtcttgcagcgaaaaacggcagtattctgcttcggccgtcaacggaatctttctgacagacgataaagacggcatctcttatccgctgatccaaaatgtttccggccagatctcccagatccttggtaaatactacggcagcggtgactacatggtatctgacctggcagaaaaagaagaggtacaaaggcaatccaccagcgttatgagtattgttgtcgcgttcttagccgggctgctggcactgatcggcatttccaatgtatgggcaagtatttcaggcaacctgcgccagaggagccgggaattcgctatgctcaagtcggtcggcctctcacccgcacagctctggcgcatgctgttcctggagggattggatctgggattgaagccgctgctttacagcctgccattccaggccgcggtacttgcgtgcttcctttacctcaatgaggtaaccttgatcgaatatctgccttttgcgccatatgcagctgtccttggctacaccatgcttgttctcgcttccattatcggagcttactatatgggcggacgcagaattgtacgccagaacatcatatccgcaattaaggatgataccatctgatgcagaaacgggcatgtccctgcgcagaattctctgcccggacctgtccgttctgcttttctataatgccttttgcaagcgccagcccgattccggcgctaccttttgccgcatccgctcctctgtaaaatcgttcgaacagatgtggaatatcctttttagaaaagccccgtccaccgtcctctatcaccatctccgtataaagaggattttcttcacagattacacgaatcttactgttttcaggagtatgctccagacagttcttcaaaatattcaacagagcctccgctgtccactgcatgtctgcagaaagccagacttcctgttctccctgcccttttgataaaatttccagatcaacctgtttctgctgcagcatggctctgagcggttctgctgcaagttccgtcagttcctttgcttctacatcctccctatgaaattcaagcgtatgcgaatccagctttgccagggtcaaaagcccatccaccagtcccttcaaacgctctacctggccctccagccggttcagatactcctggtcttccgcctccagggcaggacttaaaagctctgtcatcagcgacatggaggtcaatggcgtcttgagttgatgcgcgatatcggctgttctctctgccaggatctcgtggtccctgaccgcctcttccctggtacaggcaagcttggcaacagttttgtaaatttcatcctccagatgggaaaacatatcttcccgccggttcagtgcagctgcctcgccgcgccctgccgccttcagatactctgtaaggtcttcaatcctggtcctgaaacgcatttcctttctctctctaaccaagaacacgattccaccggctatttcaaacagaacaattcctgctgccagggcatatggcaaatgatccgggaaacgcgtcagtctcctatgtccatatttacgcaaataggcatccgcatctgctgcatccgcatccgttttaaccgcaccgccgccagattccggcatgacttgcttcccctggctgctgccctgatccggaccgtccgctcttcctgctgcatatttcaggccctctggaattgaactgccttcaagcgcggcttcggtcagacgaaccgtgtaatcgtactcacggaagctgaaacagacagcagtcactacgcccgccagtatcccgggaatcagccagaatacacaggataaaagaaatgcctgcaccccacgtcctttcatatcttttcctccatccgatagccaatcccacggatcgttacaatataccccgtatccatcagttttctcctcaggcgttttacagtcactgttaatgtattatcattgacaaaattcccctctgtatcccagagcttatccaggatcaggttccggggcaaagtccgccctttattctccataagcacctcaagcaggcggtattccagtgccgttgcatccacggactgcccatccaccatcacctgcattttctcccggtcaagctgtatattcccacaggagagcacattccctccatcgtcagacgtacggcggagcaccgccgcaattctggactccagtactgctatatgaaatggtttggtaacataatcgtcggcccccatatccagtcccctggtaatatcctttacatcgtcacaaaccgtcaggaagataaccggggtatcctcccgttccttcacccatttacagaaatcatagccactgccgtcaggcagattcaaatccaggagaatcagctggaatccctccgcaaacagatccttcgcctgccctgcagaagcacagcttgtacacatatacccttttctctttaatgccgacttgattccaaatgcaattgtctcgtcatcttccaccagcaatatctttgtcatatttcctccatccggtcaaattgattataatatctgcgcgccgcttcagggctcagggaaaaacgtcggatcaatttttctatgatttgttcctcagccttgttctcctccagattatccaatatcatggccttaatgccctgttctacatagcgcagaaaatcaatgagcgtctgttccacctcatcgttatttgctccttttgtattaagtatcacttttttacaatcacctcccaaggcgagtccctccacttcacagcaccggttttcgaaggtatatctgtatctacttattctgttatttcttctcctgcatgtatcttatttctccttaattatagtattttccaactttctttgcaatcataagcaaactgatattatacgcctaataggcaccatcccctcttcgttcagttctctaacattgtgctgaatgttccggcggaccgccggcagggaaaggcagaggcagcaggagccagacacaactgtgcccgctttctgctgcctctgcctttccctggtttcgtagtgtccccacgaattaattctctaaaagtttccttgccttccatttcccacttctaatccgcaggaatgaaaagatcgatccgattccccatccgataggtattgaccaccagatggcacttgacccgataaaataagccagcaggtaagcaatcaccactcttgtaaccagatttgatatggaactcagcataaatgcccccatatccccagccccccgaagcagaccatttcccacaaacataaagcccatcagcacataaaatacagaaactgtcttcatatatttcagcccgtatcccatagcagtacctgcagagccggcattcaaaaaaagccccagaagatgcggtccaaacaaaaagataacgctggtgattatgattgaaaaaatcagaaccatcagcagacacgccttatacccctgtgtcacccgtttttccttgcctgctccaatattctgcgccgtatagctcgacattgcattggaaaagttcatattgggcatcatggccagagtatcgatcttagtagccgctgtatatcctgcaacaaacacttttccataagagtttacaagaccctgcataaacatcatgctgacagatacaatggactgctgaatcatagaaggcactcctacttttgcgatccttttcaccgcagacatctcaaacagccccggcttctctcctataaattcgggttcattttccatcttcctcatcctgcgcatcaaaacgtaaaatgaaaacactgcgcacatcccctgggcaatcagtgtggcccacgccactcccgccactcccatatgaaaacggataacaaaaagcagatccaatacgatattggtcagcgccgaaacaatcaaaaacttaagaggcgtctggctgtcccccagtgcgttataaataccattcagagaattatacaaaaacaggaaaatagcgcccccaaaataaatccgcaggtatgtaagtgaatccgcaaaaatttccttgttcgtccccaaaagcccaagcagaggagaggaaaaaatctctcccagcgccatgataaacagcccaaccacacccagcgtaatcaaagccgtatagatcgttgtcttcatctctttaatctgcgcggctccgaataactgtgagatcacaaccgtgcaccccatagaaagccctgccgcaactgcaatggaaagaaacacgacgggaaaggacgacccaactgccgccagcgcatcctcgccaacgaactttcccaccaccatagagtccaccatattatatagctgctggaacagattccccagcaccataggcagcgcaaagaaaaacagcagcttcagcggcttgccgtttgtaagattcttaaccatgattctttcccccattctcctttttgtatcccactacattttgggagatacgcttaacaaattcctgatttatcttccgttcttcctccgtgaatcccctgtaacagatatcatcccaggcttcataaatatcacagatagcatcataaaccttcagtccattttcagtcagcgaaacaatcttctgacgtctgttcttttcattaaccacccgatgtaccagccctttttcttccagaagaaacattgtgcgggcaattctgcttttatcaatgtcaagatcctcagccaattgttcctggctgcagaacttatcctttaaaagccgtatcaggcgcccttccagcgggctcagtccaaactcttccaattcactgcgaatatatgccaactcacaccgcctgataatactgacgtaataattcttcatgcttcctcccataattacctttgttgctcgtacaactgttgtgttatacaactgttgtacaacacaacaattataccttcacttcccccaaaagtcaaggagattgtgaacttgtgcggaagggggggatgcgaagggggcgctaagtgtgagtgaaggatggagaccgcaggggatggggaggcgatttctggatcctgtccgtttgcggagaacccgtaggagaaaaaacagaaaatagggagggtacttgccgcagttggcccgaatgccgatgcattcgcgccgccggcggcaacagaatttgttttagtaaaacaaattctgccctccctattttctgttttttctccaacgggttctaaccgcgctctctatggactcagaaatcgcctccccatcccctgcggtctccatccttccctcacacttagctaggtgcatcctatatgcacgtaagttcattgcccatagggctgctcctaacgggaacagcggatgtattacgactgtgcgtgaatgttcagtactctgtacggtatcattattttcttcgttcaaatacttttaaaaaatcttcagaaatgaactatttactgcaattgtgcgtctcctatatccagctccatcagccgggcgtccccataccagccaccgcttccgcttacaacaaagcctcccctatggtacctgaaggcatttgtatattaaagttttttgtgattgtcgctccaattaccgcaaaagtatctgcctcaggcagttcacctccgctttccatggatttggaataggccaggaacggtactttttctcttgtatggtctgtacccgtataagtagggtcattcccatgatcggctgttatgatcaaaagatcatcttctctcagcctatccagcaggattcccagtttttcatcgaaccgttccagttcctgggcataccccaggggatcccttcggtggccccataaggcgtcaaagtctacaaggttgacgaaacacaaacccttgaagtcttcgtgctccgcaacttcgatagtctgctccattccgtgtacggagcttttggatttcagtgcctttgtgatcccctggcctgcaaaaatgtcgttgattttaccgattgatataacatccaagccattttctttcagcgcatccagcgcggtcttcccgaatggctttactgcataatcatgccggttgcttgttcttttgaattctcccttctttttccccacataaggtcttgctatcacgcgtccgaccttccattcatccctcatggtcagctccctggctatctcacagcagcggtacagctcctttaggtcaaaggtttcttcattgccgcagatctggagcacagagtctgcagatgtatagacgatcatatggccggtcgcaatctcttcttctccaagttcgtccaaaatcaccgtaccgctctcacttcggtttccgatgactttgtggccggtacgtttttccagttcttcgatcagttcttttggaaacccggtttctgtaaacgtaataaacggcttttctgtccttagccccataatttcccagtggccggtcattgtgtcttttcccctgctgcattcattcagctttgtataatatgccagcggatgttgtacaggcggaacctgtgcaagaggatgcaggtttccgatccccagcttcccaagattcgggatatggaactgttccacactcccggatatatgtccaagcgtgtcggcacccgtatcctggtactctgccgcatcatcggccgcgcccacccccaatgaatccacaacaatcacaaaaattctctgatatttgctcatcgtatccctcttttctgtatataatgtcttctttcctatattatgctagatttgccggaccgaatcccacaggaagcaattcttccagggtatggatttcataatgctccgtatccaaagccaggataatctgaaactggtccgggcggcagaattccatcattacctgtctgcatacgccgcagggagccgtcagatccgttacgattccatccattcctcccacaatacagattgcctcaaactttttttctccctcgcttacagccttaaaaaatgccgtcctctccgcacagcagctgggggaatacgctgcattttcaatattacagccctggtagatacgtccgtcttccgtcagaagggctgcccccactttaaatccggaatagggagcatacgcgttccccattgcttctatcgcctgcccaatcaatttttccaccggcgccattccctatcacactccttatgatctaaaccgattcgatatgtgaaaattctcatctatctccttaaagcttataacagtccatttaaacctgatcttcttttatcaattctctcacagcctctaccgccacacggattgccgcgtctgtatcatgaacaaccggattctccagtccctgttttgccctttcctgatttgccatcacgagaaataccgaccccgccctcactctcagataggaggctgctataaatattgccgcagactccatctccgaagccttgcagcccagtttcacccacgcatcccattttgctgtaagttcatatcccacaggctttgtctccggtgaatgctggccgtaaaatgaatctttgcactgcaccacgcctacatggtaagttttttccagtctttgtgccgctcttacgagtgcattcgttaccccaaagtccggcactgccggaaattctatgggtgcatattctttacttgtcccttccatgcggattgccccgttagcaatgacaagatccccgctttttacatcaatatccatccccccgctggttccgatcctgataaatgtatctgcaccggccatcaccagttcttctacggcaatcgccgcagacggccctccgatcccggtggacgtcacactgaccttcacgccgtccaatgtgcctgtataggtgatgtattctctattgtcggcaatcagtaccggttcctccagatattttgcaatgaaggcacagcgtttcggatcacctggcataatcacataccttcccacatctcccttgccaacctgaaggtgatataatttctcttcattttcagaataattgatcataatctcagtcctttcctattctttccgtttgcagcagttccgttttactatttgttatgaattcacctgcatactgcttctacgataataacagatacagtcccttcctgctttttttgcgtcatacaatgcccgatccgcatacttcagagcctcctcgaaactgtccagttcctgaagactgcctttccatacaccaatgctgacagtcaccctgccggttttgacatccgctcttggcaggccggcttttgctatccgttcctgcagttctcctgcaaaatctctgtccccatgagcctcagagaacttaatggcaagaaattcttccccgccataccgaactgctatcatcccgttttcctgggaataggccctaattacagctgccatctgtttcaggcattcgtctccatttagatgaccgtaagtatcattatactgtttaaaatagtcgatatccagcatcaaaattactgcatgcatccggctcttgtgataggcctcaaaaagcccgcgcacattttctatcaaataccggcggttataaagccctgtcagctgatccgtgcaggccattttgttcaacatcacatttgctttttctatttccctgtactgccgggcaattgtctccctgtcacggtatgctaccgccatgctctggtaactccgtatcgagataaacaatgccaggatcgtcgcaaacgaactattaatcagatctgccgtaaagttgggtaatgcagtaaatgcaagcattcctgtcagcacgctccaggaaaccccgaagatcagaatgctttccagcggcggctgaagcatcactgccgccaaagtcggaaccagatagcaataaatgacaatccccattccatttctcttatcgagaagggttatcccaataacccaggcatataagatcaccacgtagagccttctgatccacagatactcccgatatttctttttcttcactaaccatgcatgaataggaagaatacctgctgttgaaagaaagagcatcgcatacataaaaaaataccgggctgattctgcatcagcaaaaggccctcctgccttgcatgccgaaaccaacagcatacagagctgagtgcctgctacgatcatggcaatattccgttccgttttatacaccttttggggaaaataatcacggaagcccattttctgatccggagtcagtatgggatccagcttcttaaaaaatatgccagccttcattcagtatgcctccacatgccataatccacttacatacacaatggcatttcccacgctcgctactataaaagatataatgatattttaacacgagatgcattttttctctaccataattacaggatttacatatacagacaaaattaacctccccttttcatccccagtcaagaaaccaagttgacaagctttagccttatcaacaaatggttctccaactaaaaggatagccgccagcctcccaagggcgcacatgcagttcaaatctactagaacaggccttagaatttcttaggtctgtgtccgcagatttgaactgcatgtgcgcccttgggggactggcggctatcccttcctttagcgtctcacctcccccgtgtcaactaatctccaatttattttaaacgctccttcaaccgatcttctgcctttgtaaattcgcaattaaatgcttcttcctccagtttgttcagcgtacttaagtgattctcatgctgttccttatcccactcctctgcaaatgcgccgcctttaatcccctcgtactgtttcttcaggaaattccggatctcggtcgtgtccactttttggaatccggtcagttgtccatactggctggtatgagagtgatagggaagctgacggaagaatcccacttcggctgccttttccatcatgaccgccggctctttggatagatacatttccatcagaactgcttcctccggatgccccatttctacctggagtttaaatgcctccataaatacattgtaaataatcggccaggttccctgctctgccattagatccagacaggtctcgtcatcaaacgttacttcaattgcgccttttctcgtagctccgattgctttacacagcgcttttccatattccagggcctttccggatgcgtcctgatgaacgcccacaaatgccggagcgccttccccctgttcatacagttcgcgcacgccttttccaatcattctcggagctgccatgacaacgtccagatctgccgccggtttgatccgatggaatgtaatattatatgcggatgcaaagttcacgatattgcccgcttccaaattcggtgcaatctgttcttcgtaaatctccggcgccacttcatccggaagcagcaggaagatgatgtcagcccgcttcgcggcctcatcaatcggatataccataaatccatcctcattagcctggtcatatgactcatcatgacggcttccaacgatcacattctttataccggaatcacgcatattgagcgcctggctccgtccctggtttccatagccaatgattgcgatggtcttgtcgatcaccatgcccagatctgcatctttgtcgtaataaatgtttgccataattttctctcctttgaccatttcttctagacatcagacatctgatgtctgttctctagtgttagcgtaccacctgaaaccctctccgtcaacagcatttttaatttctgtggatttcaacaatatttatcatctatttttataaatactgcacaacccccggccccttatgaccgaagaaggcaggtaccatttctgatacccgccctcttctaatccggattctcgtccagagacagttctttccatttgtccagcgaatcggcaaccgcaaccgccatagcctctttatccctatgcatcaacgcttccaggatcttatcatggttttctgttacgattttggaataatcccggttcgagattacaagcgacggctggaacatttccatgatactgtttccgatactggccacaaagggattgtgtgtgctcttgtaaatccctgcgtggaattccatgtcattgtccactgtcgcccggccctttttgaaatcattcatcgtcttttcgtgaatctctttcagccgctctatgtcttcctcatctgcattgtcaatggccaggaggctggcggacatttcgatcatcttacggaattccaccaatgcatccttgctttccgctttactcatcaggatcatttgaaaaattagcggattcataacagaagcatctactgtgctgcagatacggctcccatttcctttacagatctccacaacccccagagcctccagcattttgaccgcctcgcggatactggatttgcccacgccgaaccgctcagataattctgcttccgagggcaggaaatcaccgggctttaactccccgctgatcaggccttctttgatcttttccaccaccatttttgatagcgactgcttgggaaccggggtcagccagtctgattttttctgttccatccttttaagtcctcctccagcaatgtcaattttgcttttgtttcattataatccgtttttagtttacccttttcacacacctgctgtcaaatcttattaaattgtgactttatgatttagatgaaacacagtaaaaggtgagactgattcctgggtattgagataaaaattcagaaaatattaagtctttattggtgaattctttagaacgtgggtgtactatgggatgaatggtaatgttttctaaaacgtaaatggaggaaatatgaaaaaattattgtgtgcgttttatactttagaagcagttcttctcttccagcactttgattccctgcagcagcatccagcagaccggggtctcaattcccagttcttttcccattcgtaccatgccccctgcaaacatatcgatctccgttttatgtcctgcttccagatcctggagcgtagaaggcttgttattatatgggattctgcagaccgtatcgtactgctttctcatctgctcttccgttataatgattccttttgctgccgctaccgcctgaacttccttcattgccgcccagcggatttcattggccggttcgctgctgcggaatgcaccgaagggaatccccagcagtgcacaggtcaagttttccccgacattgcacatatatttaaaccaaagcccccacatcatatctttttctactttatatgggatatcacagcgttccatcaattcgctgaccgtctttacccgctctgtttggacagtattttctgattcaccaaaatacaccttgccccaataagggtcgaagtcagccctgccatttttcatgacaatggacattctcatataagaataaagtacatgattccatccataagcggctgccaccttttcctcactctccacaccattcataacacagagtatctgtgtcctgtcacccacaaaatttctgatatcctctatggcctgctgcagccccatatccttcactgccatgataaccagatccgtctcacggccttcttccggagtgcagattggaaaatgataattcacaccattcaccgtgacaccccgattctcgaggcgctctttccgcttcccctgtgcgattacgcaaaagttgtctctccccagatgctcctccagccttggcgcaaaaaacacccccatggctccaagcccaatcagtgccactttttttatttccatttaaaatgcctcctttttcttgcaattcccttccttaataaatactatatatgcggttttcacgaaaatcaatcatttgcagccgaaacattcccttttccaatattaatgtaacattcgggcggacctgaactgttacatattaataccaaacgcttgacagttcatactgtaactgttatgattacagtatgaactgtatttcttttcgttacagaaggaggtgaaaaaaccatgaaaaaaagaaacacggtctttgccgttctgttaagcgcagcgtttctgctgacagcctgccagaattctacagaaccggcagccgaagatacagcggtgaatactaactcagatactgccggctttgagaatataaaagtccggaaactggacggaacagagacagatatgaacagtatccttagcagcgccgagctcacagtctttaatgtctgggaatcctcctgcatctcctgccaaagcgaaatggaggccctcgcagcgcttggagatcaatattccggcaggggtgtccagatcataggggtcatgaagggagttacccaaaaaagggatgaggaggctcttgcggtcatttccaagacgggcgcaaattatatccagctgctggattccgaagagctgcaaaaaatgatgcccggcctttacgaagagactccgtcaaccgttctttacagcagagacaaagagcagctgggaactgtatatgcaggtgcccgggatgaagatttctggggaaaggaaatcgaaaaatatcacagcgaagtctgtgaaaatgatcatcctgcagattgcgctgtcgggtgaacaccctggtagcagcaggctgctgctttccgcaaacctccggaccactgccggcttctccggcttttgtccggaggttttttctactacattcagcttcatttccccatccaaacggcatgcaccttatttttctactttgaatacaataaaaacaggcaaactgcgccgatacacaaactatgtaatcaaccagaatcttaactgatcaaggaggaatagatcatgcccgcaacccttaatggaaccgtatttcatgacctgaaccatgaaggccagtacgtccccggctcaccaggtatctcccaggtggtcctcgtactttattcagattctgcctctggccccgtctgtgcgtcaacagccacaggttcagacggccgatacgctttttcaatcacagtcccaggaacttatactgtctatgagactgtagcacattccggaagctgtccgcccacttatgcggtacagcccgccggttatgcattttccaacaaccccagaaaacaaaccatcacagtcagtgccgatcagattaacaaccacgaaaatattgtcaatctgaacttcggccatgacccgctgagcgccccttatccctgcagccaagagatgatactttttgagggcaggcccaccatgcggcacaccgtcaatctgatcaccggtgcatccctcctgcaaggccccctgtctaataatgggtccgtgaatgcgatcggtttcagcacaatagattatcatgtctacggatatgaccagacaaacaatactattgtccgtgtcgataatcatggcgaagtggctcttctcaatccccgccctgccggtatgcccgctgccccttattccgccggcacaatggatatggcaggattctattatatctacgtccctggaaccagccgtttctatacggtcgacctgcgcgcagattctcttactttcttaaagcttgtagatcctgctaacggctttactgaacagacctccaattacggcactcccatatcctcccctcttaccatcggagactgggctttcagccctgcggaccagaggttgtacggtgtagagagagacggtaccgtataccggattgatgaatacaccggaatcgtgacgcctctggaaacaaccgggcctaatcccggtgataccttcggctctgtagtcatagacggcagcggaaacctctatgcggttaacaatggagacggcaccatttaccgttaccggatcagcggagataccgcagcgggcacacgtttttccatgacacgtgcggacgcattcaatgacggcgccctctgcccctatgcgctcatcgaactggattatggtgacgcaccggatgcaggcggaggaggaactggaagctatcataccctgcttgcaaacaacggcccgcgccacggtaccggaagccccctgtacttaggaacacaggtgacatccgaggaagacgcttatcagaacgccaccgctaccggagatgacctgttccagggaatccaggatgacggcctttccgtccctctgcccatgctggcagtggcggccctgaattactctctatctgtcactgctacaaatgatacgagtgaaacggcatacctgtacggatggattgattttaacaaaaacgggctgtttgaagcctccgaggcggcgcctgtgattcccgttccggcctattcaggaaccagccagtataccttagattttgcaattcccgccggtactgtgataagacctgaccatacctttgtgagactccgtcttaccacagagcttttgacagacacgggcctggaaacacaggatacccgaagtgtaggccctgccgctgacggagaagtggaggattatattctcaaaatcggcgccactacggatttggcactcacaaagactgccgacagagacgtactggtaacaggagatctcatccattacacaatcaccatcataaatcacggcccggaaacggcactgaatgtcattctggaagatttgattccgccggagattacaaatcccatgtacagcctggatcagggttcgttggattactggccgggaacccttacactgggcgatatgcagcccggtcaggtcatcacagttgtgatccagggtgtttttgatggctccacactgggaccggtcgtaaacacggcttccgtcacctctcattccgaagactccaatcctgtcaacaactcggatactgtgattatcccagtcaaccgggccgccagccttgtcattgagaaaacgcctgacacagatcctgctgtgataggagaacgcctcacatttaccatctcagtaacaaacaatggccccgatgccgccgaaaatgtcatcctatatgacatggttgaaacagattttgaaaatcccgaatattccctggacaatggcgccacctggtatccatggtatggccagcttttcgcgggaacactggatgccggatttgtttacacttttctgcttcgcggaaccgttctttccggaatttctgatgcactcactaatacggcctctgtcactagcgataccgatgacccggatccggatgacaataccgttaccgttatcgtccccaagtcttcgtccgcggacctgtctgtggtgaaaaccggtgtaccaaacccagcggctgcggggcagacattaacttatattataactgttacaaacggcggcccttccccggcacaggatgttgaaataaccgatgtactttccccggatctattaaatgcggaatattctatggatcagatcagctggtttgcgtggaacgaaagccatacggtaggaatcctggaggcaggcgccgtttatacactgtatctgcgtgcatccgtcagtccggatgcagtgccgggaacgatttctaatacggtgaatgtcacctcccagacgccggacccggatccgggcaataacgaatacacggaggtaataacgctggaaggatctgcggatctcagtattacgaaaacagcgtacccggataccgccatatcaggtgaaaaactgacctataccatttatgttacgaataaaggcccctcagatgcggtaaatatcctaatatccgatgcacttcctcccgcactggaaaatgcacaacactccatagacggagtcaattttctgccttggaacggacaatacaatcagatatccctgtctgccggcgacgccattaccctgacgatcatagcagatgtttccctttcccaggcagaagacctgttcaacacggtttcggtgttcagcgatacctttgacccggatatggataataacacagattcgatcctgacaccggctgacgccctcgcagacatgcagattgtaaaaaccggtcctgactctgcggcggctggtgagactgtccgatatacactcaccattacaaacaatggccccagcagagcaatgaatattaatataacagatgtccttccggccgcagtcaaagatccggaattcgccttaaatggtatatatacaggcgtatggaatggcagttattttctgatatccctggatccgtctgaatcagcggagctggtaatcacaggaacacttagcccttccgcatcaggaactctggaaaacgttgcctccgtatctgcctccacaccggatccagatctcacaaataacacctctgagaccacgacaacggtcacatcctccgcagatctttcggttataaaagcggcctctccttcccctgccatagccgggcagtatctgatttatacgattgtggcaggcaatgcgggtccatctgccgcggagggcgtgatcctggaagatacggttccgtccggcctctctgatccggagtactccacagatgaacagaactggagcccctgggtttctccttttacaatcggtgcaatcaatcccggagagccggtcatcatttatatccgtggaactgttgctgcatccgcctcagggctgattaccaataccgtggccatatcctcccagacgccggatcctgatccagataataatacgtctgccactacaacacctgtcgagacctccgcagatctttccattgtaaagactgcagccccgagccccgcagtaccgggcagcctccttacctataccgtgtccgtttccaatgcaggtccctccgatgcacggaatgtacagttgatagatcccatatcttcgttgttatcttccgttgaatactcggttgacagcggagaaaactggacgccatggcagggaactttcaatctgggaacactccaagccggaacaggcgctataatattgatacgggggaatttgagcagcgcagcaacgggcgccatagaaaatatagccatcatcagctccacaactccggatcccgatccggaaaataacgcttccaccctatttacgccggtacagaattctgccgatctatctgttgtaaaatctgcagagccggttcccgcagcaccgggacagtacctgacctacacggttaccgtccataatgccgggccggatgcggcagaagatgtctcgctgtccgacatactgccggcagagctgtctcagccggaattatcaacggacggaggcactgtctggaatccatggtccagcccctatctcatagggacgctggagagcaatgccgatgccgtcattctgctgcggggcgcattgggcgcatccactgccaggcttttgacaaacgaggcatttgtctcctcttccactccggatcctgacccggataataatacgtacacgcttcagacaccggtcggagcttcggctgatctctcagtcacgaaagctgcattaccggttcctgcagttccgggctcactgattacctacaccattacggttgccaacgcaggaccggataccgcggatcagattgtcctgacggaccttctgtctgcagagatccagaatccggaggcctctctaaacggaggcgacttctccacctgggacggttcactgaatatcggcagcctggaagcttcccaaagcgccctcgttacgattcggggaacgattgctgccgatactgtcacaccgatatataacagggcttctgtgtcctccgatacgcctgatccggttccggacaataacacggctgacctggagactccgcttgttccctccgcgaatctctccgtcactaaaagcggaagtcccaatcctgctgttccaggagaaccggtaacctactcgctgacaatacgcaatgcaggcccctcccaggccagcagcatcattgtgattgatgcggtttccagtcttctggggcaggcagaataccgcaccgatgatgtctccggctgggaaccgtggaccggaacctggcagctgtcttccctggaacctggcggatttgccgtactgacgatccgcggcacattaagcacatctgccgcaggagtgcttaagaacacagctgtcgttacctcctccacacctgaccccgacccgtcagataaccagaatacagaagaactgcagatcgcaccgtctgctgatctttccattacaaaatccgtcagccctgtgccggcagttccaggcggcctggtaatctacacactgactgcatccaacgccgggccttccgatgctgcaaacgtaactctaaaggatacacttccgccgcagctggccggccaggaatactctgccgacaatggccgtacctggaatgaatggaagggctcctttacgctcgatcagctgaacgccggaacgacctgcacactgctgctgcgcggcctgctcgcaatccagaatctgggtgcaaaggaactcataaatacagtttccatagacagtgataccccagaccctgatccggataataatacaatgatcctcataactcctgtcagagccacggctgaccttacgattcgtaaaacagcttcaccttctcccgtttcaccgggggaggccatcacttatgatatctctgtaaacaacctgggaccggatgcggccgagaacgtgcttatcacagatgccgccatattaagtgaactggaaaatcccctatattccacggatggaggagcaacttggagcaagtggagcggctctttctccattggtactctgcagccagggagtactttttccgccctgcagataagaggaaccgtccccgaaggaatagcagctgttctgaacacagcagcggtcagcagcacgactgcagatccggattccagtaataatacgttttctatcacaacacctgtaattccatcggcggacctgtcgatcacaaaagaagccgcaccttcccctgccattcccggggaaacactgacttataccataactctggaaaaccatggccccgggaacgcccggaatattacactgattgatacagtgcctgcgcagtttatgaatgcgatgttctcactcaatcaggggcagacttggcagacctggcactccccttaccagactgcggacctggcagccggaagcagtattgtggtcctcattcggggtacactaagtaaaactgcatccggcaccctaacaaatacagccgcagcaacctcctctacacccgacccggatcccacaaacaacactgcaactgaggagacgcccgttgcggacacggcggatctgtccatcaccaaactggcccatcccgatcctgctgttccaggccagtacctgacgtataccatcctggtttccaacgccggtcctgctgatgcgctgaatgtattattaactgatcccgccgcaaacgccgaatactcccttgactccggcatacactggctgccatggtccggttcatataccctgggaaccgtctatgccggcacggtaatcagggttctgctgcgcacgattcctgatgcggacagcaccggcatactcagcaatactgctggtgtaacatcctcgacaccagaccccgcccccgataacaatacagttaccattgatacacctcttgcggacacagcagatctaaagctgcagaaaacctccgatatcacttacgcagttttgggcgacacggtcacttatcagatcaaaatctcgaaccttgggaatagagatgcggaaaatgtaatgctccgggatgatcctccggaaggactagaaaacctggaatattccaccgacaatggagacacctggcgccgctggaacagccctttcactatcggaaccataccagatcaggaatcacggattattctgctgaagggaaccgtgacggcagcaagcggcagcattgtaaatatggcttatgtcaccagtgatacacccgacccggatcacagcaacaacagcggatattccaatatcaatgtaggcaatgtaccgtcagctgacctggctgttaccaaaaaggcgcattgccggaccgtgtgtcccggacgatttgtagaatactgtatcactgtgaccaatctgggcccggatatggcaaaagatgttcttattacggatctgcttccgacaaccatactggaaccgcgctattctttgaataacggccatacctggcagccctggacagggcagcttacgataggaagcctggctgaccacgcctctgtaactctgtttctatccggaaaaatagattgctgcgcccatggtactattacaaataccgttaccgtatccggctccgtacaggatccaaatccggataacaacagcgcagatgctgctgttactgtatgtagtaactaaaggcttcataaaataaagacaggaaaccggttgcgggatacttcatctctccgcccggtttctgcgtatggatgtatcttatcgcaaacccttatacgttccagttcacattttcgtaacaatttatatataaaaaacttacgcaaaataaatgatttgttaccattatgtaacaataaggcactttttattttacacttcaatgcaaaatgttattattgtcctactttaagattacaaaagatgaggaataagagatgatgactaataaaataggcagtaacatcagggcgctgaggaaaaagaattacctaacccaggagcaattggtagaaacgctgaatatgacacgccaaacactctccaactacgaattaggaaaacggattcctgatatttatgaattgattcgaatagccgatctatttcatgtctctttagacgaaatggtcggaaggaatccagataattacaagaacaaaggctgcggtttataatcgtagtctttgttttatttatcccataaaatgccttgtcaaaaaccatggtttcatgtattgtaaatatgtaactgaaatatgcttacctgtgtttttttgagatatcaaaaacagattttcaaattacataagggcattttcactcactacaggagggcaaaactatgtttcagatttccaattttacagataatgacgatgttaagatactggcctcatcaggcccttttaccgtaattgagtaccagcgggatttaagtgtaactcccggtgatgcacagactgcttatttctgcagcgctatgaatgtgcgtaaacgccaggtaatctgtgatctcagcaaggcgaatataacactgcaggcaggggccatgcagtggaccgtaggaaatgtgaatgcaacaaccggtttaaaaggggtcggagatttattcggcaaagcagtgcgcggaaaagttaccggtgaatcggcaataaaacccgagtataaaggagatggtattctggtactggagcctacctaccgccatatacttcttctagatcttgtagattggaacggttcagttgtgctggacgatgggctgttccttgcatgcgatgcaaagcttcagcataaagcagtcatgcgctccaatttatcttctgctgtcgcgggtggtgaaggcttattcaatcttggtatcgcagggaaaggaatgctctgtctggagtcgttctgcccgcgggaggaactggtagaaatcacgctggaaaacgacatcctaaaggttgacggcaatatggcaattgcctggagcggaagcctcgactttaccgtggaacgatccggtaaaacactgcttggttctgccgcatccggcgagggactggtaaatgtgtataagggaacaggaaaagtactgcttgcccctgtagacaggccggccgtttaagataaaagaattgtacagccataacaaaaagcacatcagaaatggcgtgctttttatgatctcagtgaatcctataaggagatttaagccacctactggtaaaaggagtattattgggggctatacatcttatgaacaaaacctttccagaataatatccagtacacccgaggcggcccttctcccttccaggccgccgcttgcccagcgcgcttcctttacaagccatttgtacgatgtcagccgtcctttatttgccgatatatcaacctctcctattgaaaatgtaaccgcagtatcccgctctgcctttccgctgccgcactgaaaagatgggattccccttcccccgcttgaattaaaattataggcccccttgtgcatgtgtccgcataaataaaaatcaatattaaaattgttaaaattcttccaaataatctgctggtcactctctgaaaaccaattgaccggatgatggcctgcagctatattaatacaattttcctgatcttttaattttctgatttccttataaaaagatcctttttcgaggataagctttccttcgtcctcatcagttccggatgtaaaggccgtattcattaaaaatacattaaacttatcttttgtaatcactttatatatatattgagcctcctcattttttatttttctataaaatatattatatttgctgaaatccttctgtaattgcccaataatctccttttcatactcaaatccgctttttcttgtttccgccacggcaagatccctggagtgagacctggccaggtcatgattccccggtatcataaataactcatccggagtgagttttaagatataaattaatgcttcaataaatttcttcagattaaaatcataatatccgccctgataagtcaggtctccggtgataaatactgcatcaaattcatgttcctgggacatctcccataatttttctaatagactgtccctcattcgtttcatttcattgttctcatcagcagaaaagtgtatatctgacaaatgtacccaccttatagtatccatttctacctccagaccttaaaactggtcccccattattcatgacatcattttagcatattcttatagagttgtcccttatcattacaaaataaaaaagaaggctgctctaggcaaagcgcctccttttttataataatcaaagctgattacaaatcataatatttctcaaattccgctggatgtggtatctgtgatatctccaggctctctttccgtctgcgtttcagccagatctcaatcagtctctccggaaataccccgcccgccgtcagatattcatggtcagcttccagtgcatccagcgcttcatccagcgtctttggaagagactggatctttgacttttcctcctccggcagatcgtaaagattgcagtcataaggtccccagccatgtacagtaggatcaatccggttcttgataccatccaggccagccatcagaatggcagcataagcataatatggattggccgtggcatccggatttctcagctcaaaacgctttgccttcggtgactttgcataggctggaatacggattacagcgctgcggttagatgttgcgtacccaatcgtaacaggcgcctcatatcccggaacaaggcgtttgaaagagtttgtagagggattggtaaatgcgcagagagaaccaatgtgcttcaaaagcccgccgataaagtaatgcgcggtttcgcttaaaccagaatagcctttctcatcatagaaaatcggctctccgtctttcataaggagcatatgcacatgcattccgtttccggcttcgttatggattggtttgggcataaatgtagcagtcttgccctccaaaacggcagcatttttaatgatatatttaataatcattgtcttatccgccatgtccaccatatcgcccagttctacttcgatctccatctgtccagagccgcctacctcatggtggtggtatttcacgtcgattccccagtcttccatatacatacacatcttgcttcttaagctgtaagcgatgtcatgtggcgctgaaatatgatatccgccgcctttgggcacctgatatcctgcattgtcaggcccttcttttccgctgttccaggatgcctgtctagtgtctaccgtgaaagaggtcttatagggctctgccatatagcttacattgtcaaataaatgaaattcaaattccggcccgatcagcatctcatctgcaattccctctgacttcatatattccattgcacgcaggctgacgttccttgggtactgatcgaaaggggtattctccttcccaatcacacatacgttcccgcacatggtcatggtaggaatctccgtaaatgggtcgacaaccgcggttgccggatcggggatgaataccatatcgctcttctccaccggtgcatatccgtagttggaaccgtcaaacccaatgccatagacgaaaatatcgtcgtcgaacctttctacagggattgtgatgtggcgccaccttccgtccaaatccgtcatcttgaaatcaatcattctgattcccttctcattgcataccttcctgatatccgtgctgtttaacatgatatacctccaattagtaaatttgtttttcctgaaccttgtcccagtatttgttcaggcaacatgtcttgtctcaagatattattactattttagcatatcctggcagcaaaagggaatgttaagttcaccatttcattataaaacaggatgctgctggtaacagttcagacaggtctgaactgtttcgcatccagcccattaaaattcgcctgcggcgaagggtgctgtgcgccactggcgcacgtttagcacgaaccaaagcggagcggagttctgtatgcctgcagccactatgttttcgtacggtctgcgcagtaaatgcacagacctgtctgaactgttactgctgctgttcacactctgagggtgtacacagtaacgttatccggacataggtaagccacctataacctttggtttctgaagcatgagcatcttaatgtgtaaacccgtatacctttggttttttatctttcgcatggggaagtatgaccgcttcgtctaattcccggataccctcttctatgtcacgcatgagcagttctgccatatcataattcaaatccgcacggcagacaattctctgaatgacagtgtcttccagattcacaggcagcggataggtagggatctgccatcccttcataagcagacggtcagagagatcataaagagtccactcctgccccgttttttcttttaatgtatagcatacaaccggcaagtcacttccgtcatggtatatgagaaatcttcccgttttctcaatttcctttgccagatagtgggccacgtcctgcgttttttgctgaatgcggcggtatccctccctgccaagccggatgaaattataatactggccgataatctggctggccgatctggagaaattgattgcaattgtaggcatcttgcctccgagataatctacctcaaatattagttcctctggaagatattctttttctttccacaaaacccatccaattcccggataaacaagaccatatttatgaccggaacagttgattgatactacattttttaaacggaaatcccagcaaagctccggattgacaaacggaacgaacaaacctccggaagcggcgtcaacatggatataaactttgtgctctgtagaagcattgtattcttcaagtatctggtcaatagccttcaagtcatcaaatttcccggtatatgtaatgccgaggattccgactacaccgatcgtatactcatccacatagtttaatacggcgtctggacgcatgctcatacattctgtatccatcggcacctgacgaagttccacatcccagtaaacacagaatttctcccagcagacctgataacctgatgaaatgaccagattcggctttttgtttacatcaagccctaaaacagaggcccgcttacgccaccgaaatttcattgccatccctgccagcatgcacgcttccgaggaacctactgtagatgtgccgattgcagcgtctgtttcctcagcattccataggtccgatataatccgtatgcagcgctgctcaatctcggctgtctgcgggtattccgttttgtcaatggcatttttttcaagtgtctctgacatcagcctgatcgcctcatcctccatgtaggtctgacagaaagtagccagatttaatcttgcattcccctcgttcatcagttcgtccattatgagacgagatgcaagggctggttctaagggctgttcccttatcttgtttttcggaatcggggagtccgccgctaacgtcccgaatagaggcgtatcataagaatcttttagttttcgtttttccttatcacacattataatcatttcctcctgatcttcatttggtatagactggcacagtatccgtattctctgcagctaatactactttaccacaaaagacgttataaaggaaaatatatgagcaacttcttctatcggtttctaatatccatcgaaactttttacataaaaagcccttacaaacagcgtaaaccgctatttataagggcttgtttctaaaagattaacacaaacttagcattactgtcccatctgttttgccaacttttatttactgttttctcaaatgcccattttataaggctttctacgctttcctcaattctgctcttccattttacccaatttccctttgggtagaaacttttcattcccgttgaaagcaaatttctcttattttgctatgttgggtactcttttatgcacactgggtagagtttttatttttctgaactttctgtttttcactcacgctaccaaactttgctatttcttcttcaaattttgtttctgtcacatgagtatatatgtcaatcgttgtactgtaatgctgatgtcccattagcatttgcactactttagcgtccattcctttttcaaagcacctgctacaaaatgtatgtcggattgcatgaggataaaggtctttaaattctatcggctctctgttttcctttaccgcttctattgcttcttgaaaattgattgcttttactactttcttaatttctttttctgctacattccgaataactggacttcctaaagaagtggtaaacaccaagttatcaaattctccacttgaacgccaacgatttccataggcttttttctgcctgttctgtttttctttttgagataacagaatttcttctgtttctgccataaacggaatacttctgtatgaattatgtgttttaggctttgttagtcgcatagtctttactccattttcatattgacaggataaagacctttgaatgttaatacatttcttattccagtctatatcttcccatttcagaccaccgacttccccaattcgcatacccgtcagaaacataatgtaaaacatctctttataccagttatgctctacttcctgcaaaaaccttgtttgctctgccattgataagaaacgtctttctgctgttttattttcccaaggtacattgatttcaaaacatggattgatgtctataatacgattattctttgcagactccaaacactcccgaactctgcctaaagcatctcgcatactggaagacgctctcccctgcttattcatatcgttaatgacacgttgaatatccaagttccgtatatctgtcactttcatattccctattgcttttccaaatgtattataatatttgctacgcataggaaacacgcttgtttccttgatattaggaattttataatttgcaaaccattcctcaaaccattcattcagcgttattttctgacgtttcatatcaatattatttcttgcttcttcttttgccttttcaaacaatatttttaatttcttcaaatcaacatcatacaagttaatgtctattccgtttatctttgctcttgcttcgtatctaccgtcctttctttgacgtaaacctgttcctaattcttttccttttaaatctttacccataatctctaccctttctatcaatcaaatattttgataaataaaaagggaacttctgtgattttaaccatatactactataagttcgcctccttttcaatcagaacttcaataactttttgcttgttgctctagccatgtgtctaataatcttctgttcgcataccactgatacccaatcttcatggaaaacggacagtttctacttttcaagagttctcttgtctttgtttctccaagtccaagatactcacttacttcctttaaatttaataatgctttttctatacgattatcccctttcctctaatcttcttgcttttatgtaatcatcatacaactgtttctgtgtgatattcatttctccatttgctacaagattaccgatataatcccttttctctatctttccaacctctgcaaacagtttcaaagacggagcaacatacttttctaaccattcccacaccttttgtaaacttttcttctgtggttgcatggtaagtttaaccttacctatatctttcatcagttccgcccacgcttgataggttgggtaaagcctttttcgtgttgtcatgctgtctgtcggcttttctaaaaatcgtattttgctgttcaatacttccattgccagtcctgccacatctctatatctcaataattcctgtactacgctaactgccatttcctgccgaaatctcaactcatatctattccaattttcatctaattctgttccatactttttattctgttcatatcccttttcataaaataccaatctcaaattactggctgaactgccgagataaagactgccacctttactctgaaacacttcctctttcagttctcccgaatcgtgaaaatctatatcccttagttttgtggaaagcaatccctcttttgtccgtataatcaaatcgggaatactcaaatacggttttctatcatctatcgctaaatcaatccgaggaaaattgatgtgatactgacaaactctgtttaagaaatcaaaccatgtttcctcattgagttgtaaaaaattctcatagttacgacagcctttcccactcattaagatctgaaagccttgatactgtgcatttcctgtcggctttagcaccttgatattatcgaagattgccacaacctcatgtcctgcaatccctttttcatagcctgttaccgtcataagttccaaaggtattctcaacacatcttctatgactgcttctaacggaacttccttaatggttatctgacaccaatctatcaaggcacttaattcttctttctgccgtattactcccctgttagtgtaggggagttctggaagaaaacttccgcttctttcttccaaatttatcaaacctccttatctgcaatggcgttgccattgccctgccctcaacctgccgtttggtacgtcagaacgaggacaggaactttgaccgcctacatatttttatttggaacagggcggatacccttacaggtaatcttctccactaatacaggaaagtttcctctctgcacataaggggcataaactggttctcccagttccaccacagcataaggctcaatcttcggaagttccgttgcttccaagcgaatatccacgctgttcccaagcttcatacttccaagatgaagttttaaggcttccacttcctctgttttcttcttactgtctttatcatagcggtaacagttatccgcacccatgaaacgaagttctccaaatgcttcttttacctgttcttttgtcaatgtaatctgcatacacgttcctttctccccgttgaaccgataggtcagtttctcatattttcaatttcttattacgacgtcgtttgtggttcagttatttctgaacttaattgtatattagcacagacatatttgttttgcaataggaagtttagttttttataaactttttattttcttttttctgaacttgtggtatagtgtccttagacgataagatatgaaaagttataacgagatatggaaagagagggttttcagatgaatacaatcgcagaacggattaaatttgccatgaaagcaaaaaataaaaaacaagtagatatagtcaaagatacaggtatcagcaaaggggcgtttagttcctatctttcgggacaatacaaccccaaagccgataaaatggaactgatcgccgactccttagatgtagatttgcgttggctttacggacaaaatgtgcctatggaacatacaagtcaaaacgataacgccctgcaatatgtcttttataacaactcctgctctgagtatcttcttgatgatttagatgatatatatatcgccatgatgacacaatatgccgccctcattccacgcttttatgtccttgtcaatcgtgctggaaatgcaatgcacatactgccactatttttgaaagaggatagttcccaattctatgaatgcccgtctgatttcttttattccgacaggcatacaatttttacaagagattttgaaagcattcacatggtattaacaaccgccacgatttactattatggaattgatacagcaacctatgaaccgaaagttaccatgctctcctactcacagactgacgactgctttcatatcgacaacggaatacaagacggtcacataaaagcatttgaaaaggaactggagaaagaagcactttacttaaagcataacgcccagtaacagacaagaggacttgcaaggtttccgacctttcaagtcctctgctgtatcatggtgctgttggctgtgtccgttccgtcaaggactgccctacggcgtatcggctacgccttgttccttgacctcactacattttctctttttcttgacacaacaaaagcctgcacgaattttcttcaatccgacaggctctcattctttcacatactctatcagttcttctattccacactccaagtaactgcacagtttacagattagttgtgcgtctaatctctgaaattcatttctgcaataacgattaaaattagacctcggtatatccaattccttacaaatggtattcttactaattcctttttctttcagcagttcctctatgtgaagttccaaatgtccatacttcattgcctcacctctacataaaagcatattcaataaatctttatgtagtaattcactatatagtgaggtactatatacttatccctataactatacagaaacagaggtatatcaaaatgaaaaagaaattgttatttgccactattattctagtcttgcttgcaggcattctctattacattagcttgcccgattatcttgtatttaacagtatgtcattcagcaatggggctaatcgtgataccgaactacaagttattgtatatcaatactggaatacagatgaagtaatagcggaaatcgaagcagaacataatcaaatcaacggaactcctactattcttacaatcaatctgtatcactctaaatggtcttttcgcaatggatatgaaccattttatagtaccactatcaattataattaaaaagaaaaagcagacagtcaataaaaaaactgtctgcaataatatggaatttacccctttaaccctctcgcctgtctatccatatcttcaataacaatatcatagatttctccgatttgagaacaatattctaacactttccatggctcatttgtatgaaaatgaattttaatcaattcttcatctccaaccgccaataagcaatctcctttaaaattatttgtgaaatattcatttattttatcttcatcaagattttcgccttcaatcaaaagttgagtatcatatctaaattctaacatcctattatcctccaaattcacatttttgaaagacaaactgaagtttatcagattgtgtacttcataggggtaaacctaatcccgtctatttcttgctcgtctgattgtggcttaaatccgatatgaagataaaatggcttaccgtatggtgacgaatttaaagtaatctcgtgcaactttggagcatctttcaaaatatctgctaaaagatactgaaaaattgaagtagctacaccttgacgatgatattctttctttgtgaatgctaagttgatatgcttcctgtttgaatacataccgataattccaatcattttacccttgtcaaacgccgcatatatagggcagataccttgttgacattttgaaataaattcatcattttcaactatatctcgcttgaatgtttcaattccctccggtttatagtccggtgcttcaaattgtaaaaacacttctaatgctaaagcaagggcttccattacttcattgctatgtatttttcgtatttcatacatatctccacctcaaattctaatttgtttatttctcttattctagcatattccccaatctttaacattatttttttaaaaaatttgagggcatattgcaaaatgcaatacaccctcaacactcacagcgttccctttctatttttaaacaacaagtaaattcctcgttaagaggttgggtaaatttctttacccaataccctacccaatctgtacccaaaatagcacgatattttgtgagattttacagtagttcataacacttgtcaaaataggcagaaaccgcttaaatacgctatttaatttgctttttaccagtcttgcgattgataaattagtttcccatctgcgctgctacttctgccgcgaagtcttcatttttcttttccaggccttcaccagtctcaaaacgtacaaatctcttaattgatacattcgcattgttctcttttgctactttttctacatatttagcaactgtcagatcactgtcctgtacatatgcctgatctaacagacatacttcttttaactctttgttcagacggccaatgatcattttctcaatgatattgtccggcttttctggattttccttcttagcctgtgctaacaggatctctttctcatgatccatgtactcctgggaaacttctgcgcgggatacatacttcggatacatagccgctacctgcattgccacattcttcaggcatgttctgatttcgtcatttactacatcagcatcagcctctacgagaacaccgatgcggccgccgccatggatgtaggatacaacacatccgtctgttactattttttcaaatcttctgatattcagattctcaccgattactgcaactttctctacaagcgcgtctttcacagtctttgttgtgtcttctgcccatgcctcagccatgaatgcatccatatctgctgcatctgtatctgctgcctgattaacaactgcctctacgaatgtctggaaatctgcattcttagcaacaaagtctgtctcagaattaacttctacaattgctgctactttatcatctttaacaacggtttttacaataccttctgctgcaattcgtccggcttttttctctgccttagcctgtccattctttctcaggtattcgattgctgcgtccatatctccgttagtctcgcttagagccttcttgcagtccatcatgcctgcgcccgtcatttctcttaattcttttaccattcctgctgtaattgccatgattcattcctccattattcattcttgattgcatattttaaaaatgcttcaacctgtatccacaggctgaagcatcccaagtccataattactctgcttctacagtctcttcagctactgcttcttctgcagcttcttcataatattcttcttcagcacctgttgcgccctgattagcctcgattactgcatcagccatcttggaaacgattaatttaacagctctgatcgcatcatcattacccggaattacgaaatcaagttcttctggatcgcagtttgtatcacagataccgatcaatggaattcccagtgtatgtgcttcctgaacacagattctttcttttttcgggtctacgatgaagattgcatcagggattctcttcatttctttgataccgcccaggttcttctctaacttagcccattcttttttcagttcaattacttccttcttgggaagtacatcaaatgttccgtcttcggacattctctctatatcttttaaacgctgaactctgctctggattgtcttgaagttggtcagcataccaccgagccatctttcattaacatagaacattccgcagcgctctgcttctgattttatggcatcctgtgcctgtttctttgttcctacaaacagaattgtaccaccctcagctgcaatgtcagcaacagcctgataagcatcatcaaccatgcctacagatttctgtaagtcgatgatatagataccatttctctctgtgtagatgtaaggagccatcttagggttccatcttcttgtctgatgtccaaaatgtacacctgcttctaaaagttgtttcattgaaataacgctcatgtttcttcctccatttggtttttaacttccgcatgtttttgctctcctttgagaccggtctgcactgtgcaggcttaggcaccgtcaaagatatccgcatgcgtgtttttttgcaacggttgtagtataacatagaaaatactggaatgcaaggcttttctgtggtatcttgtctgtattcattcttgaatttccatgctaaattgtgtggtatattctgccttatgtggctttcctacttttctgatattacttcttataacttgtctctgccccttctctatgttatgctagaaacggtatactgtttatatcttctgttttacgacagtatattataacacaattatgtaaaacttacatatatagggaggtaaaagctatgaagtttacatttgcacataacaatttaaatgtttatgatttacagagatcacttgctttttatgaggaggcgcttggactcaaacctgtcagcacaaaagatgccaaagacggaagttttacactggtatacctgggcgatgacaccactccgcaccttttagaacttacctggctgcgcgatatgaacaggccctatgaactgggtgacaatgaaatccaccttgcgtttagagtagatgattttgatgcggcttttgcaaaacataaaaagatgggctgtgtgtgccacgaaaattccgaattggggatatactttatcgaggatccggacggatactggttggagattgtccccggaaaataagaacataataaaaggaatccattatgtggattccttttttatattctgaattaccaatatcttacgtatacagaaacacgtacagggcttacacatatcgttgtgcccggctgctgtgcttcaatcatctggccattgcctatgtatattgccacgtgtccgggagtccatgcgatgtcccctggctgcggatcactgactctctgtcctccatagagctggtctgtatcaacacggccgattgagatacctgcctgtgcgtggcaccactgtgtgagtcctgaacagtcaaggcctacatatggtgttgtaccgccccatacatacggaacaccaatctgagtccatgctgcatttacaattgcctgcgccgcggaagtatttcctgaaccgccgcctccgttattgcccggatcagatggagtctctggtgtgctcggggtatctggagtaccaggagtctctggggtaccaggtgtttccggagtgtttggtgcagttccgccaccattgctcgttcctccgccattatttgcgctctcattctttgccgcttcctccgctaaacgctgtctctcgcgttcttcttctgcagcttttctcgcagcttcctggatctgtgcgtcaagattttctacttcggcactcttgctttcaatcgtattgctcaactcagtctgctgcgcctcatactctgtctgcatatcttccagcttgttcatatcttcttccagcgtagttttcagttcttctacttcattcaccgtttccacatactcgtccagcatgttacggtcataggtatgtatcttctgaacatattctgcctggcttaacatctctgcaatacttccggaacttaagatccgttccactgccgagccatcgccctcttcatacatatacttaatacgaagcttcatatcctcgtactgctgcttttcttttgcttgtgcttcttccagctgcttctctgcttttgtgatttcctcacctttcgtaatcaactgattctgaagatctgtcatcttagacatcaatgttgataactgtgactgaagactgttcacctcattctccgcagcttttttctgttcttccagacctgatgtgtttggcgctgcaaacacaggtacggcaatcatagaacatgtcagtgccgttgcaacaaacatattgcgtactcttttcattttcataaaattacacctatccttattttttattatctatgtccccacatatattctttactatacaatattcatcagcatttttcaacaggatattctgaaaaaaactataatattgctggaaaataattgaaaaggatcctcagtaccgattatactggggatcctctggtttcttctaatattgcattctgtcttttatgaaatagcaattcttttatataatctcgatcttaatagcgtacgtaaatcatgccgccctgcactggcccgctgatcactcctatgccataatcagctgcatgaatcatctggccgccccctatataaataccgcaatgactggcattcacacacacatcacccggctgtggatcacttacctggggccatgtaaggaagtcaaaggttgtacccagacggatataacttccagtcagacagtagctgacaaagcctgaacaatcaaaagatcccggtgcacaggctccccatgcatattccgcattgttaacccagctatatgcccgatccacaattgcatttcctgtagaaggattgtagttaggttccggggttccggtattgccgttatccggtgtattattatcttcaggtacattctgctccggctgctcgttactatttcctccgcctgtaccaggatctgtagttccgcctgtacccggatcactgctttggcctccatttgttcctggctgtgcagtatcttcattcttcttatcagcagcttctttctctttcgcagctgcctcctgctgtttcttctgttcttccaatgcggctcttgctgcttcctgaatcatggaatccagattgctaacctctgcctgcttactgttgagcatggttgacagttcggttgactgtgatttatattgtttttccagatcctgaaggtttgtcatgtcgttttcaagcgttgtctccagagtctttatttcttctacagtatccgcgtattcctgcagcatattgcggtcatatgtatgaaccttttctatgtactctgcttcactgagaagatcagcgatacttcctgaactcaatatcctctcaagcgctgaaccgtctccctcttcatacatatacttaatgcgaagtttcatatcttcgtactgctgcgtttccttttcctgcgctgctttaagatcctcttctgccttcgagatctcctgcccttttgctactaactgcccttccagttcattcatcgttgacattaatgaattcaactgggactgcagggaactcacttcgttctgcgctgcatttttctgatcctgaaggcttgatgtattcggtgccgctaatacaggcacagttatcatagaacatgtcaaagcggttgctgcaaacacgttgcgtactcttttaaaattcacaatcaattcacccatccttattttatttatgatctatcatgtccccgcaaatacatactgcagtatcttttctgccggctgccgctgaaacgcccgcagcctgtaagttgcagaattccctatcgatacgcagtctccagtccttttcatcagaacacagaaactatattatatgcagaggactcgtcaaaattcgtcttatgcttacatagactaaattataaaggataactgaataaaatgcaatataattttaacatatttgtaatattttagaaattcgtcatgattgttcgcgcccttggggtgtgggaagaaacaatccgctgttaccatctggtctgcagccagtaaagaagcgcttacatgactctcaaatggctgaattcttcatggaatctcagaagcgatgttcgctcctggctgtttcctatcccatgctcttccacataactctttatattttttacatctgtatttttgaaagtccatacctctcttgctggtctttcttcatcccatgcaccagacagcaatgctctgaattctggaatcctataccacttggaatttgaataaaggccgccgttttgcagttcccctgaaacagtttctgactccggttttcctgtttcttttcctgtcttttcattctgtctttttagattcttttcgtaatattctctgttgataaaccgcacgtattttaaaggctccggcgacgttatttccccatcctttacaatatgtaccgtacattgactgaaagtctctttgccctctccgtccggccccatactgtctttggccgaaaaagtaattacgatataacccgaatcttcaaatcttgtaaattcgtccggatgaaaatcttccaattttactgcctgttccattctgccgggatatcgctcatcctcttccttatcctttaccgtcagggcgccagattctatagcgccgcgcagcagcgcttcttcggttattctgccttcctttgcctcttccagtgtgaaataccgatcctccgcctctatcacaggaaattcattatactttaccttaaccggccattctcgtgttgtctcattaccagcactgtctttcacactgtaaataatctggtgttccacaggtgcatctttgtcatccagctctaaaaaccaggtatccagttttttatcgtctggcatgccggtcttccatcgtacttcatacgcctcctgtttctgtccatcccgaagctttcctctttgatatttgattccaagtatgcggatgtcttttgttatgtctccgtcttcttgatcctgtgcttttatgtttgccaggagcatgtccctggtaacctcggtgccttcgaagaattcctgtataccttctgcagtgatttcgggaaacttatcccagagtgcatataaccgtacctgctgaaccgtcttttctcctgataaaggactcttcgcctgcgcctcagcaatatccagcagttcttcaaattttaccctgttctctttctggtcaggatattttactgcctgaacaggagccaccgcagagacatcccagcctgcgaatttgtatccctttctgatataatccgtatatcctttatttttatgtataaggtagccgccattcttcatgcactcctgcagggttatttcttctgacttttcctttaggacgtcgcttccgtttccataatagctcacctggattttggttccccagactgcatatagtgtgatatttcgattgatagctgcgcttaagacagctcctggctgataggcaggtttttccgctgcagcattctcggaccagcccagaaattttattcttccttcagatggaatctctcctgctatttctgcattttcataccagtattttggagtgcttttcgggacattcgccacctctccatcataatttttatgatattggatcgtatacttcgtactcagtacaatatctgccgccatggtgtttgcaccggatgcctgcatgtcccccggacgaaggcagtatccgcctttttgcgttaatgcatacctagcatactgcaaactgccctttttagtgccatatgcaacttctgccgcctttctgccattgctatagcctgacggtgtcagaactgcagcaggcgaagattttagggctgatgttactgtaatatacttatttgtctgaagatatacatcattccccgcatctactgcaccgtttccgcccatttggaagacagagccgttatggtatataccatttccgtttttcgctttgttctttgcaatggtccccccggtcagcctgagtgtccccccagacagacaaatcccgcctccactgccggaaaccgcattacccgtgatgctgcctcctgtcaatgacagcgtaccgctgtttgttattcctcccccgtttacggccgaattatcgtgaacatcccccccgctgatgcttaaggttccactgttgactattccgcctccactgcctgcattcgaatttgaaaagatttcacctccgcttaacttcatgctgcctttatttacaattcctgcgttttggttttcatatatttttccattttgtacagctgcttcccctccatggactgccaccccggttcctttattgttccggataacagctgcgcctgatatactcaaagattttcctttggcggaaattccataccgggtattgctgtaaatgctgcctccctggatgataatggttccattaccgtctatattccccacgccatccacattgtcatgtatcgttcctccggtcatcgtacagatacacgcgccttctcccacatgcacgccgcactcaccattattgtacagattaccaccggacatactgatcaccttctgtgcacggataccatcataagaattgccgtaaatgctgccgccaaatagattgaccgtgttgcaggttgcaactccatgcgctttattattataaatgtagactccgtcataaacgtttgtaattcccatgtcgttccatacaccattgcctgcggagttcataaatctggagccgttcttcaggttgatcgttgcaccgtaagctgctattacacccgatgaaccttttccattcgcatcaaatgttattgtatacccaccattgccgctgaaattccaggtgggacttccccgccagccttcttctgtgcagattatgccggcaggtatcagcgaattttctttaaaagtaaccttaacgttcctttcttccgggaatatcgaaaaggattttctggtcgttatatgtgttgccgaacagttttttatcacgtacatagatcctcggtccggcatggcatcaaatgcctcattaaatgttttgtagtaactgctgccgacccttgcagcagcatctgtcttcagcggagcagccgttgttccgggggcagccccgccttttgctgtaattctcacctgaaaggcttccatgctttttccaagattcactgtaccggctgactgtccattcttggcccagtccagccatccataggattcgcagtatgtacggtaatagatatcataggagcctgcgcttgccccggtcagcaaaatcctgactgcttccactctcagcgactgtccggtggtacctgctgtaccgctgctgtttacccagctcatccatccattgttttgtacatgaacctgatatttgacaccaagattcgtgtcaccggacgtttttatctgcaaagcctccagccgcttattttctccgatcgttcctgcagtggcgccgcctgcactccagtttttccacccatcatactggcagtacgccctataactgacgctggccgcggcacgggccgccatgacattcgcagtctcttttggctttacaatgaccctggcatagggcagggcctggagcccgtcttcctcccccttaagcagttcttcactccattcatacccttcctggggaaccgccgtatatatatactgttcatattccgtatgttcaatatcctccgcacactcccatgtaacattgattgtcttttccgtcggctttgtatccatcggatcttcgtcctcgtacaaggcatccttaagaatctcttcatgatcagtatctttcttgttattttctttcttatcagtatcttcctgatcagttgctttcttgtcagtatcttttttatctatatccgaattctcttccagcagtacttccagatttttgggcagcagttttatgacatcggcccgttcctgatccgatatcgtaacggtcagatacggctcctttttctgtacatcgaaatcctggataccgcagattatctgtaactttggagctatttccggcttcgtactgtgaatctcatccagccggttaagtgccgcctcatatgcttccgttgcttccggctcattttcggactgcatcttttccaagacattcgcaagtccgatgatatctgcatgagtctgtgtctggagatactctgtatattcttgaaagtcatgatattctgcagattcttcccccttggcggcagcctttcctcccatgccttcacagaatatacggaatgcctcttgttctacggcctccttccaccgaatatcctctatttcttcctgcgccagaccagtatccttgtttttcatcaacagctcccatagaaagtgaatatgctctgtcttcccggatactgcttccatctcttttaccgttacatcatccaatgactgcataccctcagaaaaggatgtatccttcgcaacggctgtgagcagcagatatttatacacaatagcgaattcaaaatgctccctggcagttattctgtttaaaaataattccctctccttttcatctgttttttccattaccttcaaaggttcttccataaggagcagcccgtgtaaggtttcctcaaaccatgaagcagtatcctgcagcggctgctgttcatttgatccatcaggttcttccggtacagtcgggctttcttcatcggcttccgcgatttcgtccggtttttcgatttcctctgttcccattcttcccgtctcttcctgtgcatacagggatatgggggcacatacagacaaaattactgccgcagcagccagcattgttatgcatctcttctttttcatctacaaaacttcctcctgctcataaacagcctgaaattccatatcatcccctgcacataacgtatttatattttctttgccgtacagaatcccgatcccatttaccggttttgtcattttccagccgcagaaaatatatcctttcttctccaatccgctttctggcagcattgccgcactgagcctgtcaccacagtgtacgctgatcttctttaaaacatagttgttttccgtatccgcttctttggcaggcttctctgcgaagaatgaaatataacagggggtttctttatcttcttcgagttcttccaatatcactgtcttacggcaggatacctcaccatatccgattatctgcctgaatctggacttagccctgacatccaacagacccttttcgacatccacatttaatatctctaccgtaaactcagaattactcgttgttttcataagaaacccctgaataaaatctgctgtaaattcatccgtgccggattccttttcgatatgatatactggatttactgtcaggatcttcattgattgttccatggcttcgctaagactgctgtccagttcattttttctggtagttctgttctccgcagtctgaatggctgctaaagaaattaccagtattacaatcataaaaaagcctattacggcattcttcataccttcccctttcctttttattgaccccggaggtcaggcattacggggtgctttttcacaaagcatccgctgacttttccccgcttttatcttgcatatcctactatttgatgctctaaaaacaagttcagcacaggaagagtatagtcatatgtcagcgtcacttttgcaaatttcccgcggtctacgcttgtcatcggttcaacgaataaatccgtatatccgttttccagtgctttttgcctgcagctccgtattacaggggctgtaaagtcccctgcttcgacctctgccactaccgcagaatggtaattctgcgcactctgggtgttcagggatgccatgatataggctgcgctaagcacggccatgaatgcgatcataatcatccccatcattgtctctaccgctcctttcatcttctgccctcttttcttttgggacttctttaccgtcccttttatttctgtccatatacctaacacaagatcactttagtcaaccaggacagaatatttcttttcttttgccctcatacttccctgaaaggattcttctgcacgatatgtgatctgatattccccgcttataaaagggacaaacatgcggggatctgtctccccggtgatatcctgctgcccgggagctgtcaatttgacaatcgtaacaggcaccgcctccccttcctgattgaccgccttgatctcaaacagtccgctatccagcagattatatttcctgcctttttgcagctttcttaccgagacagagagctccggggctttgcgcgaaaatacggtctgtgccatggcaaatgagtcctcgtttcctacagctgcctctggccttgccttagaaatcattccaagaaagccatgattcccccttccgaacaggaacagaaccagcattcccaaaacaaccgccaggataatcacttttccatattctccgattacagccttcacccgcagacacctccttcaaataccttcacccccgcatcggcccaagtccttccagaaatccggcaaacagataagaaatctgtccatccgctccaagcaaatctgccattgttcccagtagtatcaggctcaaaatacaagcggtaatgataccgccatactcttccagaaattctttcatagttcatcactcccatatccataaggaataccccatagcttctatcccccagtctcacagatcattctcaaaatatcccacaatccggacatcactgcgtaacccataactgagattgcaatgataccgccatactcttccagaaattctttcatctctcaatcccctcctctcagccggcatgattcaccgctgataaaatgtaaactacaaccagcgcaagatcggccagcatctttaatacaccggttatcattggcagcaggatcagaaaactgatccctgcaatataatcctctgtcctgagacgctccgctttatctgtcattacagctcctctttcagccagagggcctatctgaccgccgatatctgaggcgccgaattctgccatcgaatacaaaaccttcattgctgaagtcacatcgggaagcggcacctgcttcataaacgaaagataagggcgtactgaatccggcttttcttcaatccccgcgagaagagtattcagttcttctcttagtattgccggggcatgaggaatcgattttgataaggaaacatgtacattatcggtctgcagatggagtgacatactcatcagccattctggaaatgacttctccacctctcttgacacatgtttcaatgaaactctgtatctgcgttccggctggcctgccaaaagcgctgccagaatcacagacagcactgcagccggcaggccaacgtacaatgccataagaacactcaccggaatcagcaggatggcaatacaccatgccttgcgcctttcctttttcctattgctatgcattacatactcatattgccgttttaccgtttcttctccctggccctcttctccacggatcaggctttttgacagcttcatctgcgcaagataccagatcagcatattcagcagcaccgtcaccgttgtcacggtctgggagacgacattttctgtaatgccaaactccttgggaagcatgagtacggtcatgccgcagatcagaaaggatagccctatgccaatggtaattttaaccttcacatttttcttttccctctgcagttcatacactctgtccatccagagtttcctgtcattcagcaggatatctgcagcggcagtaaaatccccgcccacagcctccgcctcgatcagaaaatcatgaactttatacatccttctgcatccgtattctttttcaatcattgcaaatgcttcccggtaaagattttctcccgtgctttcattttgtatatagcgtatagcgctatgtactgcatcgtacatgcggctctccccctcctcaaacaaaacgagtgtatcctccagcgccgtcagtatcttggaccttcttttaaaagaatacagcatctgttcaatataggaggtaacatcctcaaaaagccgggcttcatataagttgcggtatgtcatggcaaatatccccggtacaaaacaggcagatgccgcggcaatgattataatactgggcagcttcagcctaaaagcaaacgctaataccgccacacatccatacagccccaaaaagtatcccgcatatctgcgggccgaaaactgatacccgaatctgtgcaccgttctctttaaatacccaggattcagataacagatttcctctcctatctctttcttcttcatcctctcctccgcatatttaccggcatactttccatatcggaaaatggagccgtaatatcttccagcttaaactttttcattacgttttccggaatttctctggatataaacttcccgtcttccgcaatcaggcattttacattctgctcgcctatacggtcaaaaagacatatctgatcgataaacctgacaactttttgtctttctgtcaccttttttctaagaagcacacctacattcaaaaaactgtagatatcattctctaaccttgttgcagcataggcatcctgcatcatattctggattctgtccgggatcttcctcgtgtcgtccgtatgcagagtcgtcagtccatgaagtcctgtagaaaaacactccagcagatatttcacctccaccgaacgtgcctctgaaagcagaacccactggggattctgcctcagggcagtcttgattgctttcgtgtacgggaaaaattcctcatccacctttagttccacgcaattagaacccggattaatctccttgtaatgtatctccaggttgtcctctatggtcatcaccttttcttcttttggaatatattgcgtcagaaactttaagagctccgttttacctgcccccggacgtccgcagaagaccatgttcatacgagcccggatgcagttaataagaaagatcaaaagctctcccgaacagtactgctcctttaacatgttttcaacagtcatccgcatcaccgcaggtgtctttctaatagatattgcgtagcctgtattcgtagcactggagtggataatcgaaatgcgaaggatatctgtctccgcctcaagaacattattatacttattaatctggctgctaaccacattagacactctgatgctgaactggctcacaaattccgccggcagctgtacctcaactttataaatcccgcgctttaaatgctctacccacacatccgccccattaaaattaatgtccgtgatatccgggtctattacatagggaagcaacggtccaaaactttcttcttttaaattccaagcctccctggaaaccttcacaggcagctctcctttccctcaatcaccctacgacagatgccgtagtgccaagtgcagtggtcagcttttccaccgcagcggtaattcccagcttaatactattaccaaggggcgtggcagccacaacaataatcataatcacaattgccgccacgacaatgacaccatattcttccataaatgttttcatacacaatcctcctatactttcaatccatgcacagtaattttatagagtacgactccctctataaatgcgcagattgacctcatgtcagtgggggataccgatttctctccgtccgccactgccgctcatcttgttttatgtgatccctctctccacctgctaaggttggagacttctcactcagttagttaaacatgttactgcagactattcatgcaaattcagacaatcaataaacatcaccacactttcatttaaattccgcagtttctgcactaaaacccgcacaaaaaccacagtactatgctcaaaaccgtccctgacggcccaaagccactatcagcccaaaaaggaataaagccgggagaattcccgaaaaaaattactgcgacagaacaaaaaaatgccctgaaagaataaacataacaaacaaaattcaactacaccctggaataaaatcacgaaaaaagaacttatccgaatcagtgcccaacacactgaaaagaaaataaccgattaaatcaataatttatagaactaaattatataacatataatatcatatgttatataacatgtcaataccaaaacaaataaaaataaaataatattttaaaactttctatctcttaagcgcccaaatctccacgctaaataaagataaccctgcaaaaaatacatagcatactatttaatcttgccaaaaatatcagacccatagcacagccccaaaccctaaattttaaaaaaggaaaaacaaaagattctcagattccctgaccaaaaagaaaaactccagataccaaccaagatacgatctacatctagattaccctccccaccctcaaatgtcaagaccaaatcaccacaaaagctaaaattgtaaaaaacaaaaaattaaaaataaaagtaagttacttattttatgaagtactagttctcaatccatagagtaagcgttagaagctgtcaacaaaaaacaggaaaatggagggcagaatttgcttcgaaagcaaattctgccctccattttctcctgttattttcctctacagcttcttcgcgaacggacaggatagaaaaccagcatgcacagccccggctgaagcaagcttcccctcgaacttggcgccctctactgcaccgacagattcgtataccccatcaagctcaaatccacctcccgtgctacttcgcgtccctcacggatagcccatacaaccagcgactgccctctgtgtatatctcccgttgcaaatacattttttacggccgtctcatacccgtctggcgccgtcttcacattgtgcctttcatccacttcaacaccgaaggcttttgtcacatagctttcacttccgataaatcccgccgcaatcagcaccagatccacatccacgctatattcgctcccgggtatttccgccatcatcattctgccggttttttcatccagcttggcctgaagcttcacaagcgaagccttgcacaccgtcccctttttatccttaataaattctttcaccgtagttgtatataccctgggatctgctccgaataaggcggcggcttcctcctggccataatccgtcttgcagattttcggccattccggccacgggttattatccgctctttgatccggcgcctttggcatcatttccagctgaagcacggactttgccccatgcctgacagcggttccaacacagtcatttcccgtatctccacctccgattaccagaacctttttcccttttgccgagatatacgcgccatccttcagtttcatttgatttgcccagagggcctttgttgtagatttcaaaaaatctaccgcaaagtatattccctccgcatcacgccccggtaccttgatattcctcggttccgaagcaccgcaggccaggatcactctatcatattcttttaaaatatctgctgctttcactgtttttcctacattgcagcctgttttaaactgaatgccctcttcttccatgattgcaagcttccggtcaatgatctgcttctccagcttcatattgggaattccataacggagcaggcctccgatccgatcctcccgctcaaatacggtcaccagatgtccccgtcggttcagctggtcggcagcagccaggcctgctggccctgaaccaatgactgcgaccttctttcccgttcttaccttgggagggcaggcacgggcatatccctgttcataagcattttcaatgatactgaattcatttgcttttgttgcaacaggcttttcatggagcccgcatgtgcaggcttcctcgcacaatgccgggcagacacgagccgtaaattccggaaaattatttgttttaataagacgcgcataggcctcctcccaatttccgttataaatcaagtcattccattccggcaccagattatgcaaaggacatccgcttgccatcccgttcaatatttgacctgattggcagaagggcaccccgcaggccatacacctggccccctgctgctcctgctcttctttagagagaggcgtatggaactcacggaaatgcctgattctttcctttggtgtctctgccgtcttgtcctgtctttcgtaatccataaatcctgttggtttccccactattaacgcctcctatcttccctttttgattttgttaaatgcttccatctttgcctgttcactgcttaagcccttttcttccatctgcagaattgccgacatcatgcgctcataatcttccggtatgatctttttgaatttgggcagatactctttaaaatgatccagtatctctttaccaatcacagaatttgtgtatgcaacgtgctcctgaatcatatttttcagttcctggacgtcgtacttatccgttaacctctcaatgtttaccatatctttattcactttacggtatagatcgttcctcatatccagtacataggctataccaccactcattccggctgcgaaatttttccctgtctgtcccagaatcacaacacggccaccggtcatatactcgcatccgtggtcgcctacaccttcaactaccgcacgtactccggaattacgcacgcagaatctttcaccggccacgccgttaatataagcatttccgctcgttgctccataaagtgctacattgccgataataatattctcactggcttcaaaccgggttcctttaggcgggcatacaaccagctttcctcctgacagtcctttcccaaaataatcattgctgtctcccgtcagttccagagtcaatccctttggaataaacgcaccgaaactctgcccgccggcgcctttgcattttacaacaaaactgtcctctggcaaaccttcgggataacgctttgttatctcagaaccaaacatggtgccaaacgtacggtctgtgttggagacatctacctctatgcttctcttctgtcctttttccagagccggaagcagttgtttcaaaagaattttctcatccaacgtttttttcagctcaaaatcatataccttctttggattgaaaattctccccttccgctctcctgaatagggattataaagtatgctgtccagattcagaacggatgcccgttctgacgccggaatttccctccttttcaagaggtccgtccggcccaccagctcatcgacggtgcgtactcccagcttcgccatatattcccgcagttcttctgcgataaatctcataaaattcactacatattccggtttacctgaaaaccgttttctaagctccggattctgcgttgccacccccaccggacaggtatccaaattgcacacccgcatcatgacacatcccatggtcaccagaggcgctgttgcaaatccgtactcttctgcacccagaagcgccgcaattgccacatccctgccgctcatcaatttcccgtcggtctcaatccgcacccggtcccgcagcccgttttggatcagtgtctggtgtgtctccgccaggcccagttcccagggcaggcctgcgttctgaatagagcttctgggggcagctcccgtaccgccgtcataaccggagatcaggatcacttctgctcctgcttttgcaacgcctgcggctacggttccaacccccgcctcagacaccagcttaacggatatccgggcttctttgttcgcatttttacagtcgtagatcagctgcgccagatcctcaatggaataaatatcatgatgcggaggcggtgagatcaggctgactcctggtgtggagtgacgcgtctttgcaatccaaggatataccttttctcccggaagatgccctccttcccctggcttggcgccctgggccatcttgatctggatctcccgtgcactgaccaggtagcgcgatgtcacgccaaatcttcctgaagcaacctgtttgattgcagagcagcggtccgtgtccagacgttcaatatcttcgccgccttccccgctgtttgacttgccgtgcagctgattcatagctgcggcaagggtctcgtgtgcctctttggaaatggatccgtaggacatggcgccagtcttgaacctcgtcacaatagactctacgctttccacttgatccagaggaatacccttagcgggatagttgaaatcaagctgtcctctcagattgatcttttctccttccatatccaccatcttcgtgtactgtttgaacaagccgtaatcaccgcgtctggatgactgctgcagcatatggatggtctgcggattatagagatgctcttctcccccgcttttggacttatgttttccaatactgttcagcgtcatatctacatccagtccgagcgggtcaaatgcctcagaatgaaacgccgtataatcccctgctatctcttcgataccgatcccgccgatccggctgaccgtgtctgtaaaataccggctgataaactcttccttcagacctaacgcctcaaatatttttgccccctgataggattgaatcgtagatatccccatcttggaagcgatcttgattatgccatggatcaccgcatagttataatcatccacggcggcatagtaatccttgtgaagcatgttcgtatcaatcagctggcggatggactcgtgagccagatatggattgatcgcacaggcgccgtaacccagcagggttgcaaaatgatgtacctccctcggctccccagattccagtatcattgccacagatgtcctcttctttgtgcgtaccaggtgctgctgcagacctgatacagccagaagcgacgggatagccacatggtattcatccaccccccggtccgacaggatcaggatgtttgctccctccctgattgcccggtcaacttcaataaaaagataatcaatggctctttccaggcttgtattcttataatatataattggaatttcagccacacagaaaccatccaccttcatatttttgatcttcagaatatcagtatttgtcaggattggattgtttacctggagcattttgcagttttcctcccgcttctccagaagattcccgtctttcccgatatagatggtcgtagaagttactacctcctcccggatcgcatcgattggaggattggttacctgagcaaacagttgtttaaagtaaccgaacaatggctggtttttatgagacaggacggacagcggagtatcaatccccattgccgcaattccttcggctcctgtcctggccatattcaatatagacgtttttacatcctcgtaggcgtagccgaatgctttctgcagctttgtacattcttctcttgtatactttggcacatcctcattcggaatcttcaggtctttcaactgaatcagattgctgtccagccattctccatatggatactcatttgcatacttttctttcagtgcctcatcgtcaatcacttctccctttatggtatcaacaagcagcatttttccgggatgcaggcgctcctttaagatgatctttgctggatcaatatccaatactcccacttcggaagaaaggatcagattatcatcctctgtgatataatatctggaagggcgcaggccattgcggtcgagaaccgctcccatgcagtctccgtccgagaatagaatggaggccggcccgtcccagggctccatcatggttgaatagtactggtaaaaatcctttttattctgggacatgctgcggttatttgcccacggctccggtattgcaatcataactgccagcggaagctccatgccgctcattaccataaactccagcgcgttgtccagcatcgcggaatcggaaccggaagtattgatcgcaggcagcaccttgtgcagttctcctttcagatcatcggattccattgtctcttctcttgcccccattttatccgcgttaccgcgtatcgtgttaatttcgccgttgtgcaccataaaacggttcgggtgcgcccgctcccagctcggattcgtattcgtgctgaatcgggaatgcaccatcgcgattgcggattcataatcctcatcctgcagatcttcaaaaaacattctgagctgcccgaccagaaacatccctttgtagacaattgttctgctggaaagtgaagccacatatgtatcgtcgctgctctgttcaaaaatccggcgcaccacatagagccgcctgtcaaagggaagtccctgctctattttcttcggcctctcgataaatgcctgcataatacacggcatacagtctaccgcctttttacccagaatttcaggtttaacaggtacttctctccaccccaaaaacttcagaccctcttttgctgtgattacctcaaatatctttttcgcctgatttcttttgagttcgtcctggggaagaaagaacatccccaccccataatctctgtttttgggcaaagaaaaaccgaggggtttacaaaccttagagaaaaatctgtgtgaaatctgaagtaagattcctacaccatctcctgtttgaccctcggcgtccttgcctgctctatgttcaagattttctacaattttcaaggcattcaccactgtctcatggctttttatgcccttaatattcacaaccgccccgatcccgcagttgtcatgttcaaaaccggatcggtacagcccggcctgccggcccatatttagttcacccataatccctttcctttctccataatagtaatgttgactttttatttttccctactatactacaattttttttatttgtaaataaaaactttactttaaattatctgttaatttgtcaatatgaactattccccctttttttcaggcatttattcttattttcttatttttacctcaattcttcacatttttaagtcattttcccaatccatgccaattgaaaagccgagtacatacacctcttcaatgtcctgtacccggcttatgttagaattggttactattcacggccacgtgaatagtaactcaaattgttttatttaccggaacatatccggtgtaatcttattttccgcaggaggcggagtcacatccggtttttcgtcaattctctgaataagtacgaacataatggaacctgcaaaagcgcagactactgccgcgattcccattctggaaacttttgcggcaagccagtcgaatcccccgatatcagtgacgatcaaagaggtaatgttagcaaccacatgcagcacagcgggagccttgaaagatccgtatttctcataaacataagaaagcagaagtcccaaaataaagctgtacaaaaactgcaccacattcccatggatcagcccgaacaaaagagaagaacaaaccgcggccttcataaagctgccgcgctcccggtatcttttaaacagaactccacgaaacatcagttcctcggtcagtggtattacgagcccaaggcagaggacctgaaccggcacgctggccgaatagaacacttccgaagtctcctgatactgttggcttgccattgccaggctgctcatgattgtcagacagttcgctcctatacatactgccacgccaagtccgatgatttcgccgtatttccagatatttgccttcttattctgcggaatattcagcatcttctctctttttctatccattaaaaacagcgacaatgtcaacggaatcgtaaataaggccgcgaacccaaggatctcaacctgatacttctgcacgatctccatgaccttgcccgcattctgccacgccagattcataatctcatcctgcgtcatattatcagaaaatgcgctgtaatctataatttctccgagatgtggaatgattgcaaacatttccactataaatcttgccacaaactggatgacccaatacaaaagaagaggaccaaacagccgccagaactgctttgattccggattcttattcattcttttgttatcctcgctttctcctctatccacgccctcacttcttcttctttcccttttagagatccctgtaccatctccggcttaccgcctccgcgtccgccaaacgcctcattcagtcctttcgcaaggggacggatatccatatttgtactgccgatcacatagcggtatgccccgtcttctgtcttcagaaatactgcgcagcactctgctccgcgtgccagaaccagattcatcaggattctggggccgtccccttccagcccgtcttcaaacaggcatacgaaagtttcctccccggatatcccgccggccctatactccagcagctttttctgttcttccaaaagctttgccttcaggcggccgcactcgtccttcagatgctccgctgcctggctgattttatcctcttttgcagacaagagtgcagaaatattcttcacgtgctgttccttccccgcatagtcagccagggcgcggaacccgcacagcatcgtaaccctcacgccgcctttataccgctgtacatttgtcagtttaatcaggccgatctcgcctgttctttttacatgaggagcacagcaggcacaggcatcgtaacccggaatcgtcacaatcctgaccgccccctctatctcaatcttacttcggtactccagcgaagccagttcctcctttgatggccaggacacctgcacctccaggtttttcacggctgcttcattagcctgccactcaatcttccgcagctgctcttttgtaatctccccgtcaaaatccatggtgcagtcttcactgcccaggtggaatcccacattattgtatccaaatccggcatgcacaagtcctgatacaatatgctccccggtatgctgctgcatcttcaaaaagcgcatatcccagtctatttttcccgtcacctggagaccttcctctaaaggcgcctccatgacatgatagatgatgccgtctctttcccgtacatccgtcaccctgatatcttcaagccagcccgtatccgcatactgtccgccgccctctggaaaaaaggcagtcctgtcaaggaccacctcgtaatattccccttttggccggcacatttgtacatttgcggtaaacacttttttatgactgtcttcataaaataacttttctgtcatattctgtatttacatcctttccggcgcttcaaagccgagcaaatcaatacaagtctccaaaatctctttcaccagctttagaagagcaatatatcctgctttgcgttcctcatcctcttctgtgagaatctttgtctcatggtagaatttattaaatgcattggccaggtcgtaaatgtacgcgcagatcttgtgcggtgcgctctcctcgtaggccgcgtcaattacgtcattgaatttgaccgcctccagcatcagcgccttctcaaactcgctctgtgcgtcccttaccgccaggccctccagggctccctttccttcctgatacttattcagaatggacttaatccgtacaatcgtatacagaatataaggccccgtattcccttcaaaggaggtaaatctgtctacatcaaaaacataatccttggatgcctgattggacagatccccgtatttaattgccgcaagtcccacaatcttcgctgtattctgcgcttcctcctcactcacggtacgattgtccataattttgccatacatcgtttcattgatctcacggatcagattctccaggcgcatgactccgccttctctagtcttaaacggcttgccgtccttcccgttcatcgtaccgaagcccaagaatttcatttccacttccgggcgcacaattccagttttctttgcacagcggaatacctgtacaaaatgcagttcctggcgcttgtccacaacataaatcaatttgttcggctggtaaagtgcttcccgttccaccagcgttgccaaatctgtcgtatcatataatgccgcgccgtctgacttcaggatcatacacggaggcacttcttttttatccgcttcctcctgcacatcgactacaagcgctccctggtcgtaatgggcatagccttcgtctttcagccgctgcaccatgtcgggaatatacttctgcgcatccgcctcgcccttccaaaggtcgaattccacattcaggctctcataattcttcttaagatccgccacagatacattcatgatatggttccagatggcccggtatcctcggtgcccgttctgaagaagaaatgtggcctgcagcgccttatcacggtattcctcgtgttctttggcatatgcgctggcagttggatagatctcctccagctcgctgattgtaaaaggagcttctttgggatattctccctcatacgcttcgtcaaaatatgccaggtcaggctttctcttctccagctccgttataatcagccccatctgatatccccagtctcccagatgaatatctccgattaccttgtgtcctttaaacctcgcagtacgcttaacactctcgccgataatcgcagacctgaggtgccctacatgaagcggctttgccacattcgggccgccgtaatctaccataattatcttgggctgtacggctttctccacgccaagtccctccgcagccatcatctcattcagatatgctgccacgtacgcaggactcatcttcagattcataaacccgggcttgaccgcttctgctgtctcaaagcaggaatactctccgagcttccccagaacatcctccgcaattacaaatggcggctttttataggtctttgcagccgccatcgcaccgttgcactggtattcgcataaatccggcctgttggacagagtcactttcgcaaaagactcatcgtatcctgcttcctggaaggctttctgcatctctatggtaatcagttccaataatgtcttcaattttattccacactccgttctaattttcttccattttgctattttatcacgtataatcagggagggcaagtgttatgagggaactctccccgtattttggggcatttaagtatgtttcccaaaccaaaaaccctaaatactgtttggaaaggcaggaataaagaatgattataggatcacacgtaggaatgagcggaaaggaaatgcttcttggctccgccagagaagctgtttcatacggagcagacacttttatgttttacaccggggcgccccagaatacgcggcgtaaggatatcagtgaactgaatattgaacccgcatgggaatatatgaaggaaaacggaatcaatgagattattgtacacgccccttacatcatcaaccttggaaatgcagttaagccggaaacttttgaactggcagtggaatttctggataaagaactgcagcgtacgattgcctgcagaagccatctgctgattctgcatccgggcgcacatgtcggcgccggcgtcgagaccggtactcatcagattatccagggactgaacgaggttcttacaaaagatacggactgctgcatcgcactggaaacaatggctggaaaaggctccgaaattggccggacctttgaggagctggcccgtatatacgacggcgttaagtataacgataaattgcgggtatgctttgacacctgccataccagtgatagcggatatgatattatcggacagtttgataacgtgatcgataagtttgacaaaatcctaggaatagaccagattgcagtgttccacataaatgacagcaaaaacgtacccggagctgccaaggaccggcatgcaaatatcggttttggagagatcggctttgatgccctgaactatatcgtccaccaccaggattttgaaaacgtgccgaagattctggagacgccttatgttccatcccccacatacgagaaaaaatcctatgcaccatataaatatgaaatcgaaatgctcaggaacgggaaatttgatcccggtctcacagatagaattatcagggagaatgaaaagacaggctgctagtacttgacaactgaggcgcctcattgtatgattgtactatatagataatacagtattacaaaaactttatcatacagaaaaagaggtgacttagatgccatgggatttagataatgaccgccctatctatctgcagctcatggagcgcatccagcaggacatcattgccggcatatataatcccggagataagctcccatccgtacgtgacctggctctcgatgcttccgtgaaccccaataccatgcagaaagcgctctccgaactcgaaagaagcggcctggtatattcgcagagaaccagcggcagatttattacagaggatgatgcaatgctgaaaaagatgaaaaaagatttagcatccgaacatattcatcaattttttgaaaagatgaagctgctcggttttggggatgaagagattctggaattaatccaggagacaatcaaggaggaaaagtaaatgaaaccaattctggaatgtcagggactgactaagaaatataacaacttctatgcgctgtccaacctgaacctgactctggacagagggcagattgtagggcttcttggccccaacggcagcggaaagactacattgatcaagctgattaacggtcttttaacccctactgacggacgcgtcatgatcaacagcctggctcccggagctgagacaaaaaagctggtctcttatctgccggaaagaagctatctgaatgaccacatgcgggtggacgatatactatcctactttttagatttttatgataattttgatctggaccgcgccaggaaaatgctgcacgatctggagatcgatacacgctcacggctgcgcaccttatccaaaggcaccaaggaaaaagtacagcttgtgctggtcatgagccgggatgccgaactttatatcctggacgagccgatcggcggtgtggaccctgctgcgagggactatatcctgcacactattctgaccaattataacgagaatgcgaccattcttctgtccacacacctcatcaccgatattgaaaatgtactcgacagagttctttttatccagaacggacagctttccctgaatgcttctgtagacgagatccgcacaaaggaagggaaatccgtagatgctttattcagggaggtattcaaatgttaggcagactcattaaatacgacttaaaatatggagccaagttatttattatactccacgcactgctgctgttggccagtatactcggacggtttttctttcttgaaaaactcgacttcagcgcagaaccgaatgtcctgatcacctctcttggtttatttatatccatttttctgcttctatttacggcagtatcctttggggtgatgttaatgcttggtatccgtttttataaaaatctgtttacagatgaaggatatctgacatggaccctgcctgcaacccctgcacagcagctctgggccaagattatatccggcacaatctggtatgtcattgatattttgctctacagcctgagtctttacattttggtcagcggtaaaaatgttacaacagcctacgcagaaatcgcctctgaggtaacagagtcacttgggatgccgctcggccggtacagtctgtacatgctgttatttatactggccagcagtataggaagcgtcatcatgatctattcttgtgtggcaattgggcagttgtttccgggccacagagtgctgtgctccgttgttgcttacataataatatctacaatcattcaaatatttacctttataatccttactgcccttggcatatttccgaacggcagcaactacccgcctggtgcaggcaatgtaggccattacttatttgaattgtttaggttaagcggaatcctgatatttgttacaacagtattggaatacgccgcaacacattatattatgaacaaaaaggtgaatctcatctaaagaaattcacccagcgtctgaaaaaagcgttccgaatcaaccggctttgggaaatatctattcctcccgctctgcgttgccttatctatattcctctgaaaggcatttgcagaaagtccgatgagcggaacgctttttgcttctctcttgttctgcgggcccaatttgccggccgcttaaaatatgacttgtaccaggaacatatagaatacagtacctgctccaatgctcaaaaggttgttgcgtttccaaacgtgcagcaggataacggccagcacggctaatgcttccggaagaccatggggggctgtccttatgggggtatccttcaaacagtatacgaccagcattccaatgacagccggagtcaggacttttccaagatactcaattgtcttggggattgccttccccttgggaaatattagaaatggcacagcccttgtggcaaacgtagtgacagccacggccaaaataatgcataatgaagttcctatatttacgggcatgtctccacctccccttccaggcgttttcttgcggcaaagagtatcaaaatgctcaatatcattgtcggaaacacaaaacttccgctcccgaaaatctgaaagcataaaacggctgaaaccacaccgatcattgcaggtatcctattctttgcttccatccattgctctacaaatatcacaacaaacagggcggtcatggcaaattctattccctcggcgttgatgggcagtacgctttttaaaatacctccgatggctgagccgatgacccagtagctctggtccagaagcgcaatggcaaacagaaacttatcttcctcaacatcctccggaattttggtagtacacaaaagagagtacgtctcatccgtcagtccaaagatcatataccagcgcttgccgcccattttgttaaacttatctaacagggacaggccatagaatacatgccggatgttcaccatcaaagtcataaatatgacctgtagaaaagaaatacccggcacaaaaaaattcacagccaggtactgccccgaccccgcataaacaagcaggctcattaaaaccgcccaccaggcagaatatcctttttccgcatacataacaccaaaagcaatccctatgaacagatatcccgtcagtaccgggatcgtataaggaaaagccctcttaaacgcagtcttataccctgacatgactacccctctcctctgcttctcttttgttataatccacgctcagtaatttcactgagtacgctgcatcttatctatataaaataatatgcctggaaatgtattcccagttttctgttaatgcccggtgctaaaatacatattttaatacgatactttttccagggcataaaaaatacacgtctgggcggagtcgaaccgccgcacatgcctccggagggcattgctctatccactgagctacagacgcataattgctgtgcaattctgctgtaatggaatgaacccttaacagaatgctttattatcctagcacaaaatttgtgaaatgtaaagaggaaaacaagatttcgtgaagagctttcacctcggtgcggatcgggaaacgctccaggtaggagcaaccgaaatcctcccggaagaacctgtctggcaggcaggttcttccgggggctttcggctccccctacctggagctggcgcacccggcagacagggaaagactcgtttccaggatgccccgtgtacgatctatccccgttctccgcaccatgcatccccctttttcatggacattaacttcttctcctctctttggtaaaaataggcatgatcgctcagtacttcctccggttctacctgggtttcattaatttcaacaaccatctcgctcatttcatctgcatcgagtgccttggattccggaacaataatcagttcgtgtatgctgcttggcagaatataatagtcttcttttaacatttcccccaccatctccagtacatgagggtaaaacaggcatgcagctccataattgcggagagaattcgtcaaaacgtacataacatccttcttttcatcgttttgaatttctagcagattatcctcctcatccgagtccacttccagcatctcctcaatggcatggcgcatagtataaaactctgccggcagaaggtttgttacattcctgaccgcagcccggtacaactcttctttctgtacgccccacatcttcagatgttcattactgatctgaatactggccgtcccattcctgtcttgttctaaaagtacatagaacacaatcgataaatccagtacttccataaaagggatacactccaaaagctttttgtttttttctgtatggatgagacggaataccactcgctccctgatattttcatacttttgaaactggctgcagtcccatactttcctgcagtccacctcttcataaaagtccagaatctcctggacaaccctgtctatccgttctcccttcaggacccgttcaaatagttcttccagataaatagccggcgcagcattcacgccatctgccttaatcataattccctgcttctcactgccattattctttcgggcagtatagacgctcgcctgaattccctcctttaattttttatttaattcctgttcaacagcacacaaaaaatcctgataattcataattctcctttcaaattttctgtgctcatcaaaacaaattaggaaaattgacacgacctgtgtccatgataaaataatgatttgaaacatattaggtgagtaaattatatatgattttcgtcaaaaacacaatcccaaataaggcaaaatattgttgcccttcatctagccgatgcatcccagtactatactggtatatgccgttgtaaaacacttttgtatgcttactgcatctaaaaaaggaagccggatatgcagagaaaactcgattttcaaatcaagttttcaggaaacccggttcaggaaatcatcagattcccacaggggttccccagtcctcatatccggcatcggtttttctcagatacagctagcggcacaggtgtctaatacaggccaatacccttcctagcagccctgtcgtagagcgtcccctgctccgctctgtttcttttccacattaaacacgtgacaaatattcccctgtacgtgtatcaatctttaggacatctccctgctctacaaacagaggtaccatgacaactgccccggtctctactgtcgcaggctttgttgctccctgtgcagtatcacccttaaatcccggctctgtctctgtgattgcaagctctacaaacagcggcggctcaacagagaatacatttccattatgagaacagatttttactacttcattttcttttacaaacttcaaagcatcaccgacaacttcagcattcagtgcgatctgatcatatgtctcaacgtccataaagttgaataaatccccgtcctgatacagatactgcatgtctttccggtcaatacgagcctgttcaaacttttcattcggtctgaaagtcttttcaacagcaccgccgttaattatattttttaactttgttcttacaaatgctgcacctttacctggttttacatgttggaattccagaatctgatagatgttcccctcaatctcaacggttaatccattcttaaaatctcctgctgatatcattgtaatcctccttcaattgcgctgccaatgcgcctacctttttacactgtttataattttataatagtttcattcatttttcaacctttttttaaccggagatccgcttcttttgcttctttttatagaaatgcagcacaatcttctccaggtaccgtttcaacacgatctgaatctcctctttcggatgaatcggcttaaccagtatattgcggatgccgcttctcttagccccccagacgtctgtaaatagctggtctcctacaaaaagagtattggaatcgtccgtccccataatctccatcgcttttttataattctttgtggaaggcttatgggcattataaatatagttcgtctgaatctcttcgttgaacatcttaacccgcgcttcctgattgtttgaaatcaggcatgaagaaaaaccgatttccttcagtctggcaaacagttttttagcgcggtcatccgcaggggcgccatgaggtacaagtgtattatctatgtcaaatataacgcctctgaatccatcttcatataatttttcaaatgggatgacgtatgtagacatcttatagtcatccgggaaaaatctgtcaaacattattccgcatccatctccattaactttgtaatcagttcctcacaaacctgcagcaccgtcttgttatcagtctgaatcacgatatcggcagccgcctcgtatttctcacggcggttttccatcagatcagcaataaactctacattattattctctttgagcaccggtctgtcatcactgtctttcacccgttcataaacggtctccggactcgcagtcagaagaaccacacggccgtttttcttcatctcggcaacattctccgcccggagggctgctcctccgccgcaggaaataatggtattctttttattctgcagttcgatcagcagttttgtttcctgctccctaaaatattcttcaccatatgtggcaaaaatatccggaatactcatttcttcacgatccgcaattacctgatccatctccacaatacgcatcgcaaacattgtgctgagatagtcagacaccgtagacttgcctgcgcccataaatccaatcagtactatattgtaagaaaacagcttccttgcctgtatcctcttgctgttacgtacaattctcctgaacacatcgtaaatctcgtcctgatacttactgccttccaacttatccttcagtctctgttcctgcttggcttcctgtgccggctgcaaaatcggcatgccgtattcctctttatatgccatgatcttttctacaattgcattgcgctctaccagcgcatctatgatcttgtcatcacacaaagcaagctgttcgcggtacatctctaaatcattcatcttccaacgtccacctttaatctcttattccaaaacaatacaccatattatagcaactttcccagatgatagcaagcagaaactaaccgcctatatccctattttcagctttttcgatccttttttcatttatataaagtattttctcctactctttatgggatttctccagagcggctttcacatcgcctttaaacagttcccatgcatcttcatgatccacaaaatatttgggacagatttttcccgtaacgtcatagtgccggatcacattctcctccgtcaggccaaactttttacacagccatgctgtcagctggaccacagacttataagtcgcgtcattaaactctcccgactcattcgggtggcagcattcgattgaaaccgtgtcatgatttctactgttagatgcgtaagcaatctcccatgtcggcacgcactggataatttctccgtccaggccgaccacaaaatggctgcttaccgacgtctcatggctatccttcaatccttgaaaatagtccctgttattttgtgccgtgctgcctggattagccgtgtaatgaatgacgatgccggtaatcggatcagattcagcccccggcctcgaatactcattcacatccagcagctgtacatcaatcttcggctccgaggcatccacagacagccccgtattggcacgatttctcctcccatcggcaacgcaggaataaattcccaggacaattgtcaggattaccagaaacacgattcctccatatatatagagagacttcttatcgattcttatattcttcaggtttatttttctttttgtatattttcgtcttttcatccctgtaccccaatccaaaaactgtttatatcttatcatattttgtcgaaacaaaaatgaatattttattaaaattgtcttagcaagagtaccctgtaacagataaaaccggcagacatgatgagttttaactgatggactggcattatggtaaataaaaaaccggacagttccgggatccccgcttctttactgaatatttcgggtatctccggaattgtccggttctatatgattcaaggggcatctggctcctcgccgcaggcgacttttaatgagcctgatgctgttactatgcacggcccttaggacgagcatagtaattttattcgtccacgctgtagttcggagcctcttttgtaatatgaatatcgtgcggatgactctctttcagagatgctgcagaaattttcacaaattgtccgttctccttcaactcatcaattgttggcgttccgcaataacccatgccggagcgcagaccgcccatcagctggaatacggtgtcttccacggttcccttgtatgcaacccgtccttcaacgccttccggaacaagtttcttagcatccgcctggaagtatctgtccttgcttccgttctccatagcagcaatcgagcccataccgcggtataccttatattttcttccctggaataactcgaatgttcccgggctttcatcacatccggcaaatatgctgcccatcatacaaacatttgcaccagcagcgattgccttagtcatatctccggaatacttaataccgccatctgcaataatcggtatatcatattcttttgccactgcataacagtccataactgcagtaatctgcggaacaccaatccctgcaacaacacgtgtcgtacagatagaaccaggcccgattccaactttgacagcatctactcctgcctcaatcagagcccttgttgcgtccccggttgcaacattccctgcaatgatctgaagttccggatacttttcttttaccatgcgtaccgtacgcagaacattcgcagaatgaccgtgtgcagaatccataaccacaacatctactttagacttcaccagcgcatccacacgctccagaaagtttgctgtaattccgatcgccgccccacagagcagccgtccttgaccgtcctttgcagacaaaggatatttaatctgtttttcaatatccttaattgtaatcaaacctttcaggtttccttcatcatctacgatcggcagcttttcctttcttgccttcgcaagaatcttcttcgcttcgtccaatgtgataccttccttcgctgtaatcagcccttcggaagtcatggactccttaatcttcttagagaaatcttcttcaaattttaaatcacggtttgtaataattccgacgagtttttttccttccgtaataggaactcctgagatgcggtactttgccatcagattattggcatcttccagtgtatgttcaggtgataaatagaaaggatctgtaattaccccattctcagatctcttaaccttatcaacctcatccgcctgctgttcaatagacatgtttttatgaataataccaatcccgccctgacgagccatcgcaatagccatacggtgttcagtaaccgtatccattcctgcgctcatcatcggaatattcagtcgaatcttcttcgtcaagttcgttgataaatcaacctggttcggaattacttcggaaaatgctggaactaagagcacatcatcaaatgtaataccttctccaataattttacccatgattttatttcctctctttctctaatatgtaagctgatgttttaactgatatagtacaaaaattaaacaaacttgtcaagggattcccaggtttccgcctgaaaaacacataataaatactaacccccattaaaaaccaccacttataagttggaatatatggggggacttttttggctgaaggggacgcaggggagcaggcggacaggggaagcgggcgatgcaggcggacaggggaagcgggcgatgcaggcggacaggggaagcgggcgatgcaggcggacaggggaagcgggcgatgcaggcggacaggggaagcgggcgatgcaggcggacaggggaagcgggcgatgcaggcggacaggggaagcgggcgatgcaggcggacaggggaagcgggcgatgcaggcggacaggggaagcgggcgatgcaggcggacaggggaagcgggcgatgcaggcggacaggggaagcgggcgatgcaggcggacaggggaagcgggcgatgcaggcggacaggggaagcgggcgatgcaggcggacaggggaagcgggcgatgcaggcggacaggggaagcgggcgatgcaggcggacaggggaagcggctaaataaaatttcagataaaatggcagactccgcagacactcagaaaaaatctgatgattttttcctgcgggtctgctcatttcccgaacttgtggttcgggaaatggtctgcattttatctgaaattttattgaagccgcttatcccgccctccttgatgcatcgcccgcttcccctgtccgcctactcccctgctgggcgcatcaagtcggaagaaaaaattcccccttggagggattccggcggtagctgcggattgatacgatgtggggcgctttgatttagataaggaagttttgaagattgcagaccttgtgcgagctgcgctcccttatccagcccaatccaccgcctcacgtaatcctactggtaaaatgggcatcttccgtcttgatgtgcgcagcctgccgggagcggtcagtggaatggacggaggcgtacatctgttggggctatgcggcttagagagcacggctggaaatacttacgtaaaaagagcggcccactgagggatgggaattgatttaccaaatcaattcccagtacaacctaaaacgggaaagcatcaagctttcccgttgcatgttgcacgtgccctcagtgggccgttctttttacgttagtatttccccgtaaacgggttgccgcatagccccaacagatgtacgcctccgtccattccactgaccgctcccggcaggcggacccttctcccagaagatcccctttcacccaattacatcatacccattccgccgcctgctcctgccggcattggtggtgtatcttctttgattgtagccactactgattctgttgtcagcagtgtggatgctacgcttgttgcattctgtaatgcgcttctggtaacttttgcaggatccaggattccttcttttaccatgtctacatactcttctttgtatgcgtcaaatccaactcctggttcggactctcttactttattaatgataactgctccttcaagaccagcatttgatgcaatgtggtacagtggtgactccagagccttcagaactactttagcgcctgttttctcgtcgccttccagttcctcggcaaatttttcaacttctttcgctgcgtgaatgtatgcagaaccgccgcctgcaatgattccttcttctactgcagctcttgttgcgttcagagcatcttccatgcggagttttgcttccttcatctcagtctctgttgcagcgcctacgcggataactgctacgccgccagccagttttgcgagtctttcctgtaatttttctctgtcaaaatcagaggttgtctcttcgatacccttcttaatctgggcaactctgtcttcgattgctttcttttctccacacccatcaacaataacagtgttctctttctgaactttaacggattttgcacgtcccagctgatccagggaagcttccttcagatccattcccagttcctctgaaatcacttgtccgcctgtcagaatcgcaatatcctgcagcatttcttttcttctgtcaccatagcccggtgcttttactgctactacgttaaaggttccgcgcaatttattgacaatcaatgttgtaagagcctctccctcaatgtcttccgcaataatcagaagccttgcgcctgactgtacaacctgctctaagagtggaagaagatcctggatgctggagatcttcctgtctgtgatcaggatgtaaggatcttccagatttgcttccattttttccatatctgttgccatatatgcggaaatgtatccacggtcaaactgcataccttctactagatccagttcggtaagcattgtcttagactcctcgatcgtgataacgccgtcattggaaaccttatccatagcgtctgctaccatctgtcctactgcatcatctcctgatgatacggctgcaaccctggcaatctgctctttatctttcactttgctgctcatttttgcaatggcatctactgctacatctgtagctttcttcattcctttacggagaatgatcggattcgcgcctgcttccaggttcttcattccttcgtgtaccatggactgtgcaagtactgtagctgttgttgtaccatctccggccacatcgtttgtcttggaagccacttcttttatcagctgagctcccatgttttcaaatccgtcttccagttcgatttcttttgcaatcgttacaccatcgtttgtaataagcggtgctccgaatgatttgtcaagaacaacgtttcttccttttggtcccaatgttactcttactgtgtcggccagcttgttaactcctttttccagcgctgctctggcttctgttccatatttgatttcctttgccatgtctgtcactcctcttattctaattaaattctttcttcaagttcatctgttaaaacatattattttatagaaattagtcaagcaattaaattaattttgacggacatcctactcaacaattgccaaaatgtcgctctgttttacaatgatatactcttctttttccaactctacttccgttcctgcatatttggagtagataactttatcgccgacttttacctgcattgtcacttctttaccgtctatatttccaccaggtccaactgcaattaccaatgcctcctgcggcttctcttttgcctgacccggcaggacgatacctgactttgttgtttcttccgcttcaaattgttttaatacaatcttgtcacctaatggtactaatttcatagtaattcctccttaattaattttgctagttattagcactcatttcttttgagtgctaacctcatgaatataaaatagcactctgtttccaatttgtcaacagagtttctaaaatttatacattattttgcagcttgctgcaaatccgcccgcagggtatgtgttacggtatgccctgcgggtttcttagtttataaaactgacttcttttaagtcttttgcttactttcgtttaatcggccgttttacgctgtccacattatagaatccattctctatcttaaagacaagcatattgccattctcacactgaaagcgttctttcactgctcctgtacagtaaagcagttctttcttagtggaaatatagcactgatatttggcatccagggaaattgccgtcaaatcatcttcttttaattgcaagtatatgtaatcttcctccaaatcatacttaaaaacctggcaatgatgtgtcgcatcatcaaaaattacatctgccgaaattactttttccatctgtaagtctaccgggttaccttcatacatatttctctgcctcctaaacgatttgattttctgtcctaaacttccggataattattgattgttatcataagagagggtatcagctgcctgataccctctccaatttactatactcagtaatagataaatacgtctgaacatctacagacgctctttttttattttttccagttccgtaaacacataatcattcagaaccttaatatatgtccctttcatgccggatgacctggactctatcacgcctgcgctttcaaactttctaagtgcattgacaattacggatctggtaatgcctacacggtctgcaatcttacttgctacaagtatgccttccgtaccgtccagttcctcgaaaatatgaataattgcctccagctctgaaaaagaaagggtgctgatcgcagactgcacgatgtgttcttttctcgtctcctccgcgctctcttcattgacagagcgaagcatctccagccctactaccgctgttccatactcactcaagataatgtcatcaatctcatatacggaattctgtttgtaaataaataaagtccccagacgctctcctgctatgtcgatcggtgtaatgatagcctggtacccgctcaccgcttccggcgaaaaaccaagtgtttccagattgacattctctttagtagataagatattcagcagacgttcgttcagcatctcatcgatatgcgcgccaactgactcgcctacgagttccctgatgccttccacctgtccacatttgctcactcccagtatcttgccctttttgctgacaacaaggacattagaatccagaatctccgtaaggacggcacaaatatcgttaaaaaccaccttgctggaattgttgttatgaagcagcttattaatttttcttgtcttatccaataactgtacgctcattgatttcctccagatttaattgtgtatacaactcgtttcaattcgttcgatatagttatgttatcatacaactcacgaaatatcaacgtcatttatctaattttttttcagatttcggacatatccacatttttcatctgcacatacgagtttacttcctttttctaccatataattgccgcattcagggcacttttccttggatggcttctgccaggacatgaactcacattccggattattttcacagccataatactttctgcccttctttgtcttgcggattactacttctttaccgcaaaccgggcatggaacgccaatcttctccagatatggttttgtattcttgcagtccgggaatcccggacaagccagaaactttccgtgagggccatattttaccaccatgttccggccgcactcttcacaaatcacgtctgtcacttcgtcttcgatcttaacactttccagctctttctcggcaatctgcactgcttcttccagatccggatagaagttacggatgacctctttccaaggtaccttgccttcttccaccatatccagcaggccttccatattggcagtgaagttctcgtccacaatacttgggaaagactgcttcatgatattattcacaacctcgccgatctctgtgatataaaggttctttgcttcctttgtgacatagcggcgtcccaggatcgtggagatcgtaggagcgtaagtacttggacggccaatgcccagttcttccagcatcttgaccagagtcgcctccgtataatgcgctggcggctgcgtaaaatgctgctttgaatcaaagctctccttattcagccgggtgtccatactcagtccgtttaccagaacattgctctcttctttctcttcgtcagcctctgtgtagacactgcggaaaccatcgaatactactttcgaagttgctactgtaaaccggtaatcacctgctcctatttttacagaaatggtctcatactttgcaggctgcatcctgcttgctgcaaaccgtttccagatcagctgataaaggcgcagctgatccctggaaagagaatctttcagggaggccggagtcctggtaatatcggtaggcctgatggcctcatgcgcatcctgtatcttcttctcggtctttttcgcctgagcgcctgcagccacatactcttttccataagctgacgcaatatattctcttgccgcttcatccgcctcttcggagattctggtggaatccgtacgcagataagtaatcacaccgactgtcccattccccttgatatcaattccttcgtacagctgctgtgcaatgcgcatcgttttctgtgttccaaaattcagtaccttagcggcttcctgctgcagcgtactggttgtaaaaggaagcggggccttgcggatgcgttctccttttttaatatcagtgattttaaactcttcgttgtctactgctttgattatctgattcagttcctcttctgaaccaatcgtcatcttctgtttctctgtaccgtaaaacttagccaccagcggacgcttttcgccttttacctttaaaacagcatccagagaccagtattcttccggaataaatgcatcgatctcggcctccctgtctgcaatcagacgaagcgcaaccgactgcacgcgtcccgcactgagtcccctttttacttttgcccacagcaccgggcttatacggtagcccaccattctgtccaggatacggcgtgcctgctgagcgtcaaccagactcatatcaatatccctgggggcctttaaagatgcctttacagcatttttggtaatctcgttaaatgtaatacggcgcattttcttatcatctaatttcaaagccgttgccagatgccaggatatcgcctctccctctcggtcggggtcagttgcaagatagactttgtcggctttctttgcttccttgcgcagattcgccaggatatctccctttcccctaatcgtaatatatttgggctcatagtcgttttctatatcaatgcccagctggctcttgggcagatctcggacatgtccgttcgatgcagcaactgaatagttgctccccaggaactttttgattgttttcaccttggcaggtgactccacaataaccagataatgtgccataaaacttcctccaataggctttcacgcctctatttatcattttatcttaatataatgattttttgaaatctctttgatgtatcctttcagttctaacgacacaagccgctcaagcacctcgtttgccggcagcttcgtttcctctgtgagctggctaagattcttgggatacaaaccaagacgactatacaccatattttccccactttcaagcactttttcaattttggctgtttttttgttctcttcggtacagttcatattcagctcctccaggagcatttccgtcgacaacagaatacctgccccctgtcggatcagctcattgcagccctggctcaggctgctgttaacaggccccggcagcgcatacacatcccgtccctgctccagggccatatccgcggtgatcaatgatccgctcttctctcgtgcctcgatcacaagaaccaaatccgacaaaccgctgataatccgattccgccggggaaaattctggggtgcgggaggggttccaggcggaaattcggacaggattcctccttcttcttctaaaatatccacatacagcccgatatgttcccgtggataacagatatccacaccacagcctaataccgcatacgtatgcccttttcccatcagagcgccccgctgggcggttccgtctatgcccctcgccagcccgctgataaccgaaacatcacactctgcaagccgctccccgaattcaaaagcatacttttctccatagggtgtacagcgcctggcgcccacaatcgcaaccgcccttttctcctcttgcggcagtctgccttttacgtaaagcgcatagggcggatccggaattgtcctcagtcttcctgggaattcccgggaaaaacagggaataaagcggatggatttctcctccagctttgctgctgtttcttccggatttcgctccttttgcgcctgcataattgtatggatgtccctttcatttaagaactctaattcttttagttttgtttcttctatataaaatatacattcaccggaaccaagatgttttctcagcagatattttttacggtcactcaaaggtgtaatagcagcaagccaatattcatatttcattttctcatctcccccagtattttttgtccatcgtacggtaacctattgcttcttttatatgtttcacagcaattctatcctgtccgtccaaatctgcaatcgttctggccaccttcaggattttgtggtaagtccgggctgtgagcctgagggaagtaaatgcctgctccatcagcctgttttccgcttttccaagcctacagtatacctccagctctttaaccccaagcatcgcattcgaaacaatacctgtccctgtatagcgccggttttgaatttcacgggcatcacatacacgccttcgtatctctgctgaactttcttcttttctttttcgcaaaagagcctcgaactccactttgggagcctccacgcaaatgtcgatacggctaagaaaaggctggctgatcttgctcaaatactgctggatctggccgggagtacaggtgcaccgttcgaaatcgggatagcagccgcaggggcatggattcatggccgcaatcaaaataaaattagccgggaacacataattgccgtgtgtcctcgctatgtgtatctgatgttcctccagtggctgccgcagcacttccagcacagccttctggaactccggaagttcatccaaaaacagtacgcctccatgagccaggctgatctcaccgggagcaggaaccaggccgcctccaatcagcgccgcctttgtagccgtatggtgtacactgcggaacggcctctgtcgtatcagcggtgcttccttatctaacagccccattatgctgtatatcttcgtaatctccatgctttcctccagtgtcataggcggaaggatccccggaattcgtctggccgccattgtttttccgcttcccggcggcccaaccagcaaaaggttatggccgcccgctacggctacttctgcggcccgctttacattttcctgcccctgtatctcactgtaatccggaaatttttgtacaggctccccttgcttatgttttggatacggctctggctccagccgcacttctccagataaaaaagaaataacttcatgaagatttcgaacccccagcaccgcgaccccttctactagcgcaccctcaggtgcattggctttcggtactacacacacgggaatccctgccgcccttgcctccataatcacaggaagaattcccggaactttctgtaaacatccatccaggctcagctcccctataaccagggcattcttcacattctcctcaggaatcagccccagggatacaagaattgccaccgcaatgggcagatcaaacgccgcccctctctttctcatcgttgccggtgacagattaatcaccgtcttcttagccggataatccagccccgaattgcggattgctgtctgcactctttctgctgcctccttcacctcagaagaaagatacccaaccatatgaaaagcaggaagcccattgctgacatctgcctccacatgtacaaactccaccttcagcccctgaacagacgctgataaaactgtgctgaaactcattcatacactcctttcaagcattgatcaaaaatagataagtaaataaatggaacatggccgaaacggcccgaattgacaaccagggaagaaatccccggaactggtgaatccatcatagcttactatcgcactcctgtcaagaaggagatctttgaagggagttttttgctttgagggggcgctgagagagaggggagactggtttccggcggggcgcatcaaggcggaagataaaatactcccacggagggtggatctgcggctgaggcgtatttgtgatgtatggacggatatctgatggctggagatggcttatcaacaaattacacaaatgcttcagtcattaagtcactcatatgcgattcaatccgcctccctcgcagcttcccgccccgacaaaagaaatatccatccgtccggatgcgaccagcctgtccgggagggagcttctgccgcaggccaggaaacttccatgccccttttcggctgcggcccgtttgcttagtctcgctagataaaaaccgtatcggatggggaggcaccagcggcattcaccccgcaattctgaagaattgcgcggctcaggccgctttgaaatctgcttcggaagcagatttcagcctccccatccgatacggtttttatctagcgagactaagcaaacgggccgcagccgaaaaggggcatggaagtttcctggcctgcggcagaagctccctcccggacaggcgtcccctccgcaactccctatttattttgtgtggaaaagcacaattttgacgtttttcacatagactatatcaaatgtgcttagaggtgctgttcttgaaatcttttccaaatcccctcactccatcggaagaaaaatattacatgcaaaaatatacagagggcgaccttcaggcaaaacatgtcttaatcgaacgaaatctgcggctcgttgcacatgtcattaaaaaataccagtatctcgacgaggaccctgaggatctcatatctataggaaccattggcctgatcaaagctgtcgttacatttaatccagataagggcaaccggcttgcagcctatgcttccaaatgtgttgaaaatgaaattttgatgtatctgcgggccaaaaagaaaacaagcaaggaaatctcgctgtatgaacccatcggcaccgacagagaaggcaacgaaatcaagctctatgacatcatcgaaaccgacgaagcagacgtccccgaaaaaatcaacctcaaagaaaatatccagaagctttatgacaaagttgaaaacgaactctcccagcgcgaaaggcttgttctaaaaatgcggtacggcctctacaacggggaagaatacacacagcgggaaattgccaggcagctgggaatctcccgctcctacgtctcccgcattgaaaaaagtgcggtggaaaagctgcgggaattcttttaaggtgggtattggggagttttttgcggagagggacgctgaaaaaccgggaagcctgccccaggcggggagtacctatgccattttaaaaatccgcgcctcttacgtaaacggcgcggatttttaaaatggcataggtactccccgcctggggcaggcttcccggtttttcagctggttcatccaatcggcagtaaaagcccctcccctgaaagtggcaccaaacggttgccacgtattaattcgctcggtgcaatgtaaaacccccagtaattgacttatagtaatactgttatgttttgatataaagaaaaaatctacttatcactgcatagggttatccataagttcttcaaaatattagactaaccatcttctttacaaaccaggacatactgccccctcaacgactcaatacgcctttaccgtctataagcctctggcagacaggtcttccctaccgtccggatgcaccagcgaaataaagggatagccgcaagccgtccaagtgcatacatgccgttttgaagtgctaaagcggacctaagaaattcttggaagccggcagctaaaaaagtggggaaattttgtgatcaccaaatcacaaaattaggcgacccagcgcgagaaatcatcggatttctcgtgatgtgtcgcctgtgcctcacttttttagctgtcggcttcctagaatttcttaggtccgtgtccgcacatcaaaacggcatgcatgcacttggacggcttgcggctatccctttatttcgtgtccccatcctccctccgcctaagaagatcaaacagctccgcatttctgctcaatttgatcctcagtttttgtttggaatgcggcgcgctctcctgttcttctccatcttcatttatgatctgaagcacagtagtttctatattatctccgtttggtttcatgatctctattgtttcacctacggaaaatttgtttctctgctctatttcgtacagcccgtcccgctcctgaccgataattccgagataagtgtattctttgacataggtattactgtcatagatctgagttgtctcatccggctttccaaagaagaaacccgttgtaaactggcggtatgtgcagtttgagatttgttccaggtaccagggcatgttttttctgtacagctccggatctttttggcagtcatcaatggctttgcggtaagtcctcgcaacggttgccacataaagggcagtcttcatgcgtccttcaatcttcaggctgtctatgcccgcttccagaagttcgggaatatgtccgatcatacacagatcctttgaattgaagatataggtgcctctctcgttctcgtagaccggcatatactcgccgggccttgtctcctctacaaccgcatacttccaacggcaggggtgggtacaggagccctggtttgcatctctgcccgtaaaatagttactcagcaggcatcttccggaataggagatacacattgctccgtggacaaatgtctctatttcaagatcatctggtatattatcacgcagttctctcagttcatccagggaaagctcccttgccgagacaacacggcttgctccctgtttgtaccagaaattatatgtgccgtagttcgtgttattggcctgtgtactgatatgacgttcaatctcaggacatacttcttttgcaatttcaaaaacccccggatccgctatgatcaggccgtccggttttatttccttcaattctttaaaatacgctctcacaccggccagatcgcggttatgcgccagtatattggctgtaacatagacttttacaaaatgctcatgggcaaaggcaatcccttccttcatgtcttccatagagaaattcttggcctttgcacgaagcccgaaagcctctccgccaatatatactgcatctgctccgaatatgactgctgtttttaatacttccagactgcttgccggaatcaaaagttctggacgtcttcccatttcctaatcctttctatcacatttcctcttttaactgtcctctttttgtgctgactgctacgccgtcccccagtggcagtatggacgttaccaactcttcattatgtttcagttcatacagatattcccgcatcctggcatgaatggtacggttcctgcgctctactgcaaagcgggactcgatgatgtccccatcctgcatgacattgtctgaaacgagcgtgccgccatccgccagaagccgcaggacctcgggcataaagtggatgtactggcccttggccgcgtccataaagataaagtcaaaggattggtacaagtctttcagcacctcagaagcatccccctccagcagggttatctgctgctctttccccgctctcctgaagttttcacgggcaatgggaattcttttttcatatttttctattgttatgatctcacacccctccggggcgtattcactcatcaataacgcagagaaacctacggcagtccctacttcgagaatgcgcataggtttttgtatggtgataatcaccttgaggaagctctgcatttcttttcttatgatcggaacgcaagtatccagggcttccctctcgatggcctccagtatttcactgttctctgtctccatagaattgatgaatgtaacgatacgttcatctactatcatgtcttacacatccacatccattatgattggtataatcatcgggcgtctcttcgtctttttccagatataatcattcattgtatcccggatgaccagcttaatcttattccagtccgcatgcttattggcaaggcagcgctccaggccgtctgtcacaacctggcgtgcttcttccatcagtccttctgattcacgcacatagacgaaaccgcgggatacaatatccggtcctgcaagcagacggttagtccccttttccagcgtcagtacgacgataagaataccatcctcggccagatgctgcctgtctctgagtacgatgttcccaacatctccgactcccagaccgtccaccagaattgctcctgtgtgtaccttatccacgagtttagcctcatcctcgctcagctccataacatctccggattgcatgataaaaatattctcttttggtatccccagggaactggcaatcgccgcattcgccttgaggtggcggtattcaccgtgcaccggaagcgcgtacttaggtttcacaagcgaatagatcagcttgagttcctcctggcaggcatgcccggaaacatgggcatcctggaaaattacattggctccctttgcagataattcattgataacacgtgacactgacttctcgttgcccggtatcgggttggagctgaagatgatcgtatcattcggctggattgtaactttgcggtgtacatccgcagccattctggacagcgccgccatggattctccctggcttcctgttgtgatcagcaccatcttctccggaggataatgtctcatctggtcaatctcaataagtgtattctccggtatattcaagtatcccaattctgatgccgttgaaataatatttaccatactgcggccttctacaaccaccttgcggccgtacttatatgcagaattgatcacctgctgtacacggtctacgttggatgcaaatgtggcgataataattcttgtgttctgatgctccgcaaagatatggtcgaacgtgattcccactgtcctctcggactgggtaaatcctttcctctctgcgttcgtactgtccgacatcagcgccagcacgcccttctttccgatctctgcaaaacgctgcagatcaatcgcatcgccgaatactggtgtataatccactttgaagtctccggtatgcaccacgatgcccgccggtgaatagattgccagcgcggatgcatcctgaatactgtggttggtcttgataaactctatcctgaacttaccaaggttgattgactgcccgtggcgtactactttccgctttgtaccgcgaaccagattgtgttcttttaatttattttcaataatacccatggtcagctttgttgtataaatcgggagattaatctccttcagtacatagggcagagcgccgatatggtcctcatgtccatgggtaataacaaatcccttaaccttgtcgatattatccttaagatatgttacatccggtattacaagatcaataccgagcatatcgtcttccgggaatgcgagtccgcagtccactacaataatactgtcctcgtattcaaaggcagtaatattcatccctatctgctcaagaccgccgagagggataatccttaatttaccattgtttgtttttttcaataattttacacctccatgtgttttatgtacttacttcgttactgctcagaccgtgccgtgcatctcgctgcacggcatcggagccgatgaagtgatggtctcggggcatctgctcctcgccgtaggcgactttaaatggacagatgccgttactgtgcacgcccgtagggtgtgaacagtaaccttacttcattaatgtccagaacatgccgtgcgcacctgaagtgtgtgaacagcacctacttctgcgcatgaaaaaaacagcaaccttccgttgcatttagacaacggattatttgcttttactgaggcattctttacaaagtccgtaaaatttcagttcgtgatccagcacatgaaatcctgtatcctcctcaatatgacgctccaattcctccaggaggtcatcttcaaaaggaagtacctttccacatgtcctgcatattagatgatgatggctgtgctttgtatcaccttcaaaaatatgtccgatctcatatctgacacacccgtcatctaaattaatgcggtccaccaactgcatttcaaggagcagctgcaaagtacgataaacggtggcaagtccaatctcaggatagccctcctttatcacttcgtatatgtcttcagccgccatatggctgccgctgttcttagccagcgtttgtaaaactagcaatctctgctgtgttacttttaaacctttttctctcagttttactttaagcagttcctgcactttttcctgttccattgccatactccgattcattagcagtaagtaaatctattgtaaaaatcttttgccttttatggccttccgcagcccggcccggtttaactgtgccgcacggcggatacagatcttacatttcaatatctacgtcctccagcagttcctcaaaaaccttggaaaccgccagaagctcagtatcatcttcaacaacctcatagacactgtctgcatcctctgcagaactcatgtcctttaatatgagacattccgcgtcatcttcttctgagtctgtgaccagtatgtatacagcgccattaatttttgtctgttccagaacaaaaaattctactgtttcacttgtatcctcaaatgtaaatttaatcttttccatacaaatgtccccttatttccgcagcatctgcatctgcccgcaggccatactttactcgccctgcccggtctgcctttgcaaatatacagaatccagatacccctgcaggatgaatattgctgcaatcttgtcaatatactttttccggttctcacgtctcacattgctctcaatcaaagtccgctctgcctccacggttgtcaggcgctcatcccacatgatgacttccagcccggtgcgccgcgcaagcatatccctgaactctaaagatttctccgcacgttctcctatgtcgttgttcatatgttttggaaaaccaagcacaatcttctccacctcgtattcagaaaccagttcttcgatacgcgccagagtccgcctcagcttgttctcctcttttctctgaattgtttcaattccctgggcagtaagtcccagagcatcgctgatcgcgacgccgactgtcttcgtgccataatcaagtcccataatcctcataatgattattcccaggaattgtgcgtaatatacgcttttaacaattcttctaccagttcatccctctccactttcatcaccaggcttcttgcgccgttataacttgtgatgtaagtcggatcgccggacataatataaccgacaatctgattcaccgggttataccccttctctttcagagctttgtatacgatctccagaatatcccttgcggaaatctggggacccggctctacctgaaagaattgggtgttgcttaaatcgctcatttcttctcctccatttttgtgtaccctgttattttagtgctatctgtattttccaacattcttttgataaatccggcattcttgcctaataccctatttacaattctaatataaacactgccaaaattcaatgtataatttgtaaatcattttcaatttcaacttttacgatacaattctgctgatttttatccgcgtctagtgcaattttcatatactcttttgtatggccggccagctttttcctgccattttgttctatttcttcctcgagcagaacttccacttcttttccgataaaacttttctcataggccagtctctttttctcatttagggcaagcagaatatcgcttctatgtgcctttacctgttccggcacctgattttccataaccgctgccttcgtgccctgccgttttgagtatttaaaaatatgggtctcataaaaatccaccttatccacaaaggccctggactgctcgaattcttcttctgtttcccccgggaatccgacaattatgtcggttgtcagagcaggatgatcaaagtactttctcagcagctggcatttttcatagtattccctgctgtcgtaccttctgttcattcttttcaaagttgcatcgcacccactctgcagagacagatgaaaatgcggacaaagcttttcgagtgacgaaagcctcttagcaaactcttccgttataatgcgcggctccagggaacccaggcgtatccttttgatccccccagtctcatgcaccgcctgaatcagggacagcaggctttccggctcctccagatcaatcccataggaactcagatggattcctgtgaggacgacttcctggtacccgttttcggcaaggcgttttacctcctccatcacgtcctcttttgcccggcttctcacgcgtcccctcgcaaagggaataatacagtaagaacagaactgattgcagccgtcctgtaccttaatataagccctcgtgtgctcccccgtctttgacaggcgcaggggttcgtattccttcgtatggttgatatctatcaattctctggcgagtgcggcgttgtgcccagccgcttcttttgcatcatacttgttttcatattctcccaggatagtcagcagatcctgtttcttattattgccaatcacaatatcaatacatggatctatctcctgcttgtcctcctgcgcctgcacatagcatcccgcagccaccacaaccgcatccggattcatcttcctggcccggtggagcatctgcctggacttgcggtccgcaatgtttgtaacggtgcaggtgttgataatgtagatatccgcgccttctttaaacggaacgatttgataccctgcattctccagcatttcctgcatcgcctcagtctcgtaagcattcactttacaccccagattgtgcagtgcaaccttcttcatagattaattctcctatttccttgtctaaattgttgtaacagttcaggcaagcctgaactgttacgcatccagcctattgaaattcgcctgcggcgaaaagctggatgccagcagccactatgttttcgtacggtttgcgcagtaaatgcgcagacctgtctggactattataaattgttacttttttccttctttgtttcttgacttttaaactgtcttctcgtagaatagacgtagggtaaagccctgtaaatgtatattaaggagggatttcacgatgaaaacagtacagatttctttaaactcgatcgacaaagtaaaatcatttgtaaatgaaattacaaaatttgataatgactttgatttagtatccggaagatatgtcatagatgccaaatcaatcatgggtattttcagtttagatctttcaaaaccgatcgaactgaacgtacatgctgagggaaatgtaactgacgatattctcagcgcactggaaccatacattattaaatagtaagtgattgcaacaccacacaaagcgtgtccgccccggacaccgtatacagaatgccggatcggcatacatctgcatgatatgagctgcctcttgtgagacagctctttttatgtaataggaaagtgcccggcacttacctattacataaaactctccgggggatgcacatgccgcagccggaagactcatgccccaagcacactacttcactgtcagtatctctgtcgtatcaattgccgtcttcacaagctcatctatcttctctgccagattcagctccgacttttcaatccgctccagattcggttttgtaaccggatgttttgccacaaagatggtgcagcagtcttcaaatggctggatcgaagtctcatacgtatcgatcttctctgcgatttccacgatttcccgtttatcaaatccgatcagcggtcggtaaacaggcagcgtgcacactgcgtttgtggctgcaaggctctgcatggtctgactcgcaacctgtccgatgctttccccggtaatcaggcccaggcagccgttctcctttgcaaaatgctccgcaatcttcatcatatatctgcgcataataatggtaagctcctcatgcgggcatttttcatagatatagagctggatatccgtgaaattaacaacgtgcagctgaaccggccctgcgtacctggaaaccagtctggccagatcaaccaccttttcttttgccctctcgctggtatacggcggtgcatggaaataggtggcatgcagcccgacgccccgcttagagatcatatagcctgcaaccgggctgtcgatcccgccggacagcagaagcatggcgctgccgttcgtacccacgggcataccgccaggtcccggtatgatctcggaataaagatagatttcctcccgcacctccacattcagccggatatccggattgtgcacgtcaaccttcatccccggaaatgcatccagtatcaccccgcccagctcgcagttgatctccatcgaggtcatgggatactgttttcggcttctcctggcctctaccttgaatgtctggttcccatcgggatacatttcctccatgtaggatataacatccttggaaagctgctcgaatccccggtcttccacacgcacaaccgggcagattcccacgatgccgaatactcgcttcaggctctctaccgtctcttcatagtcatactcgccttcacattccacatagaccctgccctgggctttgtgaacataaaaatctccgtctacctcttttaacgcaaagcgcatctggcggaccagagcgtcctcaaacagatatctgttttttcccttaataccgatttctccgtatttaatcaagaatgaatgaaatctcatctctctctccttatgtgctgcgcttcccgcatcctggcaggaaacgcaagattttagtgtcttgtatatttccgaagcattggaacacaattatataacgtctccagcgtatagtcaatttcttcttttgtggtgaactccgacatactgaatctcagtgttgcatccagatactctttcggggctccgattcctttgagtacaccgctgacagacggatggttggaggagcatgccgaaccggatgaaacatagatccctttatcttccagggcatgcagaagcacttcgctgcggattccggctattccaacactaataatgtgaggcgcgctgttctcatcggtcaggccgtgtacggcgatattctcgattccggagattccttccagaaaatatgccttcaattcccgcatcagggccaccttcatatccagatcactgtagatcatctgcgccgccagacctagcccggcaatccccggaacattttccgtcccggaacggatattcttctgctgttcccctccgaacacgatcggttttatcttcaccttttcattgatataaataaatccggttcccttcggcccgtgaatcttatggccgctggcagtcagcatgtcgattccctgccttttcgggtatatgtgatatttgccaaatccctgcacagcgtctgagtggaataaaatgttcgggttatatttctttacgatctgaaccgcctcgtctacgggctgtacagaaccgacttcattattcacatacatcattgatacgaggatcgtgtcttcacacagagcttccttcaaagcttccatttttgcccttccatgtgcatctaccggcaggtacgtgacacggaagccttcctcttcttcaagataccgcattgtattcagaatggcaggatgctcaattgctgttgtaatcagatggttcccggcccgcttattggcacgagcggcgccgatcagtgcaagattatcgctttcggttcctcctgaagtaaaaaagatttctttcgtgttcaccttcagaatcctggccagtctctcttttgcctctttcacgtaccgttctgcttccacgccttttctatgcatagaagagggattgccgtaatcctggcacatcactttataaaccaaatccccaacttccggatagcatctggtcgttgctgaattatccaaatatacttccatgatattcttcctttactgtttcttattattacactatgctttccgaacacttaatgttcagaaagatcctttcccgcagcaatgaaatcacccataatgctccgccttaaacgcataaatcacacggaaagctccaagtggtacatcagaatggacaaaatcgttaatccggccgtctccgtgcgcagtattctcctgcccagcgtgatgggaagcgcccccatattcacggctttttcgatctcttcctcctcaaatccgccctccggcccgataaatattccgatgctctgccccggctcaacagacgaaatcagctgccttgtctcttccattccttttgccagttcatacgggatcagcacaatatccagccccgccgcatattccagcgctgcgccaaagcctttcacctgcgtcacctgcgggatgatgctgcggccgcattgctttgcggcgctcagggcgatcgcgttccagcgctccgtttttttggccgccttcttctcatccagctttaccactgcacggttcgtagccaccgggatcacctcatagactccaagctccacggctttctggataatcagttccattttatcacttttgggcagcccctgaaacaggtaaatcttagatggcagctctgcaggctctcctgctgatgacaaaatccggagaatcacagcttcctcttcataccggtctatctcacacagatactctgtccctgctccgtcactgatttccaccttttctccaggcttcatgcggagcacattttttatatggtttacgtccggtccaccaagctctatcacggtttcatgaaccctgaacggttctgtaaagaaacgatgcatctcacatcccccactttcttttgaatctgcctctttctgacgccgtatctttctaattctttcttgcagttacagatacccattcgccctggtaagtcacttccagcacttccagcccggcttcctccactgcgcggatcacggtctgttccttatcatcgataataccgctggtaatataaataccgcctgctttcatatggtccgcgatcaccggcgtcagctccaccaacacgtctgccaggatatttgccgcaacaatatcgtaccgtgcgtatcctgctttttcctgtaccgccttatcatcaatgatattcccgatcattacttcatactgatcacggttgattccattgacctccatattctcattggtggcatttatcgcacagggatccagatccgttcccacggaataggctgcaccgaacttcagcgccagcattcccaggataccgctcccgcagcccacatccagaatctgtgtctcagaagtcacgtatttgcgcagctgacggatgcatagctgcgtcgtctcatgcatgcccgtgccaaatgcagtgcccggatcaatgtggatcacaagtttatcgctgtcttccggttttacatcctcccaggatggaatgatcaggatatcatccacatagaactgatggaaatactgcttccagttgttcacccagtcgacgtcctctgtctgggactcctctatgatacattctcccacatccacataggaagacatctcctccagttctcttctgacatcgccgagaatcttttctttatccgcttccacttccaggtaaaagttcaggtatgccactccgtcatcagcttccccctcgggaagaatatctacaaacatctgctctttgtccgcctgcgtcagcggaaccttgtccacgatctccactccctggattcccaggtccatcagcatactgctgacaatatcttccgcctctgttgtcgtctttaaccggaaactattccatttcatcttatcttttcctcctgaaacaatcttcttaatctcttcatcacctgaaaaaacgccggaatcagaaacaaatctgcagccagccacgcaagcccgttgccaaggcacactgctccatatccgaaggccggcaccagaataaatcctgtaaatcctctcgccgccatttcacacactcctgcgagtatggcaaacatactgtatcccataccctgtatcagaaaacgtacaatattcaccgcggcaagcagcatgtaacagaccgcggagcccagcaggtattggtacacctgccccagaatctggctttcccctttatcgataaacagccatgcaatctgctttccccacagaacagtaattcccagtgccactgcagaataaaccgcgccgatgataaggcagcctttcaaccctttgctgatccggtccagacgcttggcccctacattctgtccgccgtaggtcgccatggtagaacccatcgcatcaaagggacagcacaaaagcatctgaatcttagaggccgcggtcaccgaagccactgccatagaccccagagaattcaccgcaacctgcagaaccacgctaccgatggcagtgatggaatactgcagtcccataggaattcccatcctgcacagcgggccgacatatcttcggttcagtttccagtcctccttctgaagccgcagaatcgggaaatgcttcatcatatagaagagacacaatatccccgaaaccgcctgggatgctaccgttgcataggcagctcccgccacacccatcttaaacactactataaacagcacatccagcagaatattcagcagggaggacacggtaaggaaaaggaccggcgtcctcgcatctccaagtgagcggatgtagccggagagcagattatatagaaagatagccggaatgcccgcaaatatcacaacaatatactggtaggcgccgtctataatatcggacggggtgttcataagttccagtatctggcggcacagtaccactgtgatgcctgtcatcactgccgcaaagatcacgctcagagttgccccgtttccagccgatttgcgaagcccccgctcatcttttgcgccgaacttctgtgcaaccggtatcgcaaatccattgcatatccccatgcagaatccaatgacacaaaaattcacggagcccgtggcgcctacggccgcaagcgctttaacccccaggaaccggccgacaatcacggtatccgccatattataaaactgctggaacaaaaatccaaatatcatgggcagggtaaattccagaatcagtttaaccgggctgccctgtgtcatatctttcatcaatgttttcttttttactgtacttttcatcttctaagcctctgtatttcttcctcatgttatgaccgcttttcagcaatccattgtccactatataacttttcagatacacatgcaagaaatttttcagaagccagaggaatcagcctccggtcagaagctgttcaggccgtgctgtacgcagccgccgtgtgtgaacagctctcttttttctgctctttacaggccggtccgtgggcagcggctcttttctaatgtaaccgtaagattacaggcaggcctggactgttacattttaacgcactttctcaggaattgccaggataaacagagtggacaggacaagcgcaaaccccagaatatccattttcataaatctggtacccaggaacaccgccgctacaactgaggccgcgaccggctccacgcaggaaaaaagcccggcataaacagaaccggtgtactttactgcggatagataaaagcagaacggcaggattgtccctacggtgatgatggtaacaaaagccgccgcaacctgaacatcgatcacaacaggtatccgccacggcctcgtcacagccatcagtaccaggccccccacaatcatcccccaggcgctgactgcttccgcgctgtaccgtttaaccaaaggcgccgggagcacaccgtaaaagcaggtcgtcactgccaaaagcatgccaagtaaaaaccctttcggtgaaatcgccagtgacgaaaaattaccgtgcgtcgcaacgatggcaatcccggagattgccgccagaacagctgcgatctccttctttcccggcatgattttataaacaaccgcgaaaaacaagatcagcatggccggattcaggtactgaaagattgtcgccgtcccggcatccatctcctgcacagcagagaaaaaggtaaactgcatgcccagcatgccgaatactccgaatagaaccagcctgcacgcatctgtcttctccttccagacacttgtaatatcctgccgccttactcccgcatagatcagcagaagcagcccggcaaagaccagtcggaagggcacaagccattcggaaatgatattctttctttcaaataagtattgtgccgcgggacttgtaatcccccacagcatacctgccgtaaaggcatacagacacccttttaactttacatttcgattctgtgccattcttatcagacctcatattccagctggtgtatacatcgtaaattcttcattttcattgcaaatcacttccaggatatctcccgtccggattgccccccctcttatcacgattgcaaagacgccttcccttggcataatgcagtctcccattttctgaaagatctcgcagccatgatggcattcttttccgatctgtgtcatctccaggatcacatcattgcactgaaaacgggttcctacagggaatgtcttaaaatcgatcccttcaacaaccagattctccccaaaagcgccgtcggccacctccgcaccgcgcttgcggaaatcctctattttatcataagaaagaaggcttacctgtctgtgccattttccggcgtgggcatccccctcaatcccaaaattttctataaatactgcctccccgacattggtcttctgtgtcccctttgcaggacttgtacaaatcgcaattacttttcccatgtttatcccccaattcttgacatttgttttccttccagcggtccctcattctctgtcccctgtccctcatctcttttcagcgtaaactgatggcaccggggcttctcaaatatgaccttcccgatgacctcatccagctttgaatcatcggccccgcttctcagcagccgctttaaatccgcccctttcgaatactgcagacacggttttaaaagaccttccgcagtcaggcgaaccctgttgcagcttccgcagaactgatgtgaaatggcgctgatgaaacctattttcccggaaaagcccggaaaagcagcatatactgcgggaccatttccaaaacttccggctaaaaacctcggatcaccatacgcttgtttcagcacccggcacacctcctcctggctgctgccggcacaggattttccatgcccgatgggcatcatctctataaaccgcacatccaccggctcattctttgccagtgccgccagggggacccactgggtttcattgactccctgcagagcgacacagtttacttttacccggatgcccggatacttaagcgccgcctccagaccttccagcgctttcccaagctcgtcccgtctggtaatctgtgcatactgttcccgctccagcgtatcgaggctgatattaacagcatccaggcccgctttcgccagttcttcgatctgtcctgcaagcagcactccgtttgttgtcaaagtaatttgctcaattccatctatttgcctgagttcatacaaaaggccactgatgccctttctcaccagcggctctccgcctgtcagcttgatctttgatatccccttgtccgcacagatccggcagatcctggcaatctcgctgtaagtcaggatctcactgtgggcgacctgctcgactccctcctcgggcatacagtagctgcaccgaagattgcaccggtctgtcacagacactctcagatattctatttcccgtccatattgatctgtcatgcctttacccccgggtttttggcttcgcttccacattcccccgtgattcccttcatgatctccagcccatgggacagagacggcagaatgtattccagattttcttttaccgctttcgggctgcccggaaggttaataatcagggtcttcccccgcattacggaggcgcccctgctcagcatggcacgaggggtaacctgcagggaagcataccgcatcgcctcggcaattcccggcgcatttctttccgccacggcaagagtcgcctccggcgtacagtccctcggcgaaaatcctgtcccgccggaggtaagaatcaagtctgtctccctctcatcgcagagttctttcagcttctcctcaatcatcatacgctcatccggaagcagaaccatctccgtcacctcatatccggcccgctcaatcatctccctgaccagcggcccgcttttatcctcccgctccccggcgtatcccttgtcactcagtgtaataatcgctgtcttccattttatcggcatcttatttctgctccttatatataatccaactctttaacaattgactatattatagcatgaacatgcggcccttaaaagacccgaatcatccatggctttgtccattgacagtcagcttatatatatggtaatgttaataaatccaatagaatgaattggattcatttcaaacattctttgtattcattattttgaaatttctaatttcaatcctgagggcagtttcgcccgataattcaatgtttggagaaatcaaaaatcgcagggagggatgcctatgcttgttttttcgcgtgccaaatactattaacagatgaaaatatatgttaaaatagaggagaaatatatgtatactttcaaatccagatgcgaggaggtaccagagtgctgcctggaggacggagcagggaatcaaagcattggtacaggattatattgaggaaggatttgacaaggataaaattataaaaaaattacagaaaaggttcactatgtctgaggacaaagcaaaggagtattatgaaagattcaggcaatcagaatgaaggcgtatctatgccattttaaaagtcttagagtcccttaaggaaaaaacatagagaatatggctggaccgctattctctagtataactcaaagtaaatagcatgatggttcgctgcgtataatttttcgagagtgcagatgcaaaaacgcaggcgtagtggggctacgctgatgcttttgcatctgcgctttcgggaaattagaccggcgaaacattgtgctatttactttgagttgtactccggcatgaggcaggtttcccggttattcagcgtcccccgccccttgcactcccaaagctcgccccagtctcctgaatcaccactttccggagcatccagatgcaaagtatattaggaatcgccataaacgagttaaatagatctgataccgtccacacaagatccagggacatcactgcccccagatataccgccgctatataggcgattctaaagggaaggatttttttatttccccacaaatactgcaccgcacactcgccataatagctccacccaatgatagaggcataggcaaaaagtaccagtgatacggacagcatcgtgctcccgcccaccggcagtttttcaaatgccaggaagcacagctggtcatccgcagccccggcataaatccccggttcgcttaacatactgctcacgatggcgattccggtgattgcacacatcacgaccgtatcccagaatggccctgtcatggaaatgatgccctgcttaaccggggaattggttctggatgcagccgcagtcatggggatggagcccaggcccgcctcatttgtgaacagtccctttgagatccccgtccgcattcccaccatcacagctgtgccggcaagccctccaaatactgatttggaggtaaatgcagacttcacaatcacagcaagtgccgcccccagatatgcccggtttatccagatcaggaacaggcatccgccgaaataaaaaacactcataaaaggaaccagatatgtacacacttttgagatctgttttgcaccgccaagcatcacggcccccaccaggactgccgcgacaattccgattacggacggagaaatcggaaattctacctgcaccgcggcacaaattgaatgtgactggacgctgcttcccattcccagagaagccagaattgtgctgacggcaaacaccaccgccgcacttttctgatgcagcaccttttccatcacgtacatcggtccgccggtataagaaccgtccggccttcttattttgtattttgcggataggaagcactcggcatagcaggttgctatcccaaacactccggtcagccagcaccaaaacaccgcaccaggccctcctatggcaatcgcggcagagatgcccacgatattccctgtaccaattgtagccgccagcgccgtcgccagcgcagaaaagggtgagataccatcgtctccggcttcttttttcgagaagctaagccgtattcccagaggaatcttacgctggataaagccaagcctgacggtaaaatacaagtgggtacccagaagaaccaccagcatcggcattccccacaggtacccgtagatcgatttcatgatctgtgataatgtctccatgtcataaccccgcaaacggatatcactctatttatatgacaggagtcctcactttatcatcttctctcatttacattattcttttctccattccaaaaattctccggtcatggcatggatttcaaaatcgtatttatgtccgctgtatataatgtctccttcgtacttatacccgccgtcatcgtactccagagcaatcacaatatcatcctttcccgcgccctccacacgctctagggccagctcttgtgcttccttcaggctgacaccgatcagctgatccttattattctccatataagtctgcagatcctgtaggtggtacgtgacagactgcagttcctcgtttacttcatccagattttcctgaagttcttcgctgtctaagtctttctcctcccgcgcaagcagatcctctaaccgctgcttctgctcttcaaggccttcttttaacgcctccgcttcctcgagctggttctggatatccagcttgtactgtgcgtcctgctggcgtgcatatgtgctttcactttctgcctttaatatcgttccgtcatcggccagaatttcatactcatattccaccttgctttccgtattcataaaataaatttcatagacggacttcccatcctctttttctctggaaacctgaagtctggacgcttctttctcatcggtctgcgcatctgcgaaagctatttccttcgctttctcttccccgatcccttttttggcgcatccgggcatcagaaccacagacaccatacacagtacggcagcatatactttcaaaacattctttttcttcatctttttcctcctttcagcagctacatattagtgcatcatataataattaactgccacataaaccggcctgcatttccgatcgcactgctccacaagcctcagtgcagcccactacgcctacgtttgcggagcagcactctcgataatttatctcagcttatgcgtcagttacttattttacgatgtactagtttccccgcatctgtcattcatattctcagtatacctgccttagattaaagaaagattaaaaaatcccgtcaggaaagaaaaattgaaacgtactgccctccccggttctgctctctgcctcaacgccgcctccatgtgcctccaggatccatttcaccatcggaagccccagccccacatgtccgtctgaggttcttgactgatcggcacggtagaatctcgtccagatatgtggaagttccgcttgtgatataccgattccgtcatccactaccgtgccaataatactcccctcctttttgaaaagggacacctgtatatagccgccttgtctgccatatgcagctgcatttgaaagcaaattgtccagcatatgtatatataaggtttcatccacacaggcatatacctccggctctatctcagtctctattgttatcttcttttcccttgcagcgctctctagttcctgcacgcacatcagggttagctcgctcaggttcagatattcccggttcaattccagcatcccccgctctccgcgggataaaagcagcagctttgagatcattccggccatatcctctgcctttttctgtacgacccgtaccctgtcgcactgttcctttggcatctcccggctctgcagtagttcttcacactgggcgagaataacgctgaccggagttctgagttcatgggatatatcggaagtaaactgcttttcgcgctcaaaggaatcttccagccgttccagtgtccgatcaaaagtaacagccagtgtatagatctcgtcccggtttttatctttgcgttctaaagggaacacaatccgcctggacaggtctccgtccttttggatctgctgtacggtgtctgtcatctgcttcacgggaagcagcgtccgccgtgtaaagtaataacatgccgccgctgtgaccacagcaagcagaggcagcagtacagcggcaaacctctgcgtgatgcggaagctgtatatcaccctatccacagaagtaatgcctcttacatagatatttccgtggattccatcattgtgcagcatatcatagatataccaggcctgtccgttctgcgacacggtctgaagactttctacctcaaacgcaggatgctcctcaaattcataaggaatcctgccataaagaaattcgcccgcgccgtcatagagtgacagatagacattttgttccagatcgtagaaatctgcatccacctccagctcccagtccttatagctgatatatctaacccctttctgcacctgtcttttcagcgtttcctgggcagagaggaggacttccctgctactgagcgagaacaggatcgccagaaccgtaccgattattatgatcagaaatgaagagtataagagcgtcaacttcatcttcagggaaaatcttctcatagccacctccagtttcaagcagaatttccgagagtatacaggcataccccggtatgcttgcagcgatgcatgcgccatgtgctgcattacaagacagacggttatccacagttcttgactttcaggacatatcctgttccgcgcacggtatggataagttttgtctcaaattcctcatcgattttctttctcaaatagcggatatacacatcaatcacattggagccacccggataatcatagttccagagatgctgctccagtttttcccgcgacagcacgatcccttcattctggatcatatatctgagcagcgcaaattctttccctgaaagcgcaatctgttttccaccgcgcataacctcgtgggtatccagatgtacttccagatcagctattctgcagcacaccccgcctgtgtcacggggggatctcagcagcaccctgatccgggccagcagttcctcaaatgcaaaaggcttgaccagataatcattagctccggcatccagtcccgccacccggtcttcgatactatcccgtgccgtcagcagcagaaccggtatattccggccctgcgccctgagccgttttaaaacagtcagcccatccacgcccggcatcataatatccagaatcactgcatcatagtccgcggccgcgaggtaatccaatgccgtctgcccgtccatgcaggagtccacgctgtaatgctctgcctgcagcttatctataatcagccggttcagatccggctcatcttccgccagtaaaatcctcaataccacacctcctggtactctactctaatctgtcgttttacacgccagttcttttaacgtattacccgcaagacggtaaaccgtccacttttccatcggctcggctcccagagataaataaaaatcaatactgggcttattccagtcaagacaagaccactcaagcctgccacaccctctttcgatagctgtctgcgccagctttttcaatatgcctttcccataaccgcgcccccgatattccggaagaacaaataaatcctcaagatatagccctgcccgtcccagaaaagtagaaaaattatgaaaaaataaggcaaaacccacttcccggttatctgccatagcaaatataacttccgccttttgcttttcaaacagcgattcttccaacaaatctaccgttgcaattaattcattttccattttttcgtattttgcaagatccctaataaactttaaaataagttccgtatcctttcgttctgcataacgaaacgttaatgcttctgccatttccagtcctccaaaattcaagtttcatttaaatttcttatcttgctaaaattcattcagatatttttgcagcctatccgcaaatttcccaatatgtataccatctacgaatgaatgatgtgcctgaacagataagggcataacaatccgttcgtctttttcataatatctgccccagtcgaataaaggtgtggcgttatcttttttgcctgaatttgtatgggagatgtgagtatatgtgatccacggcattggagaacattgaaacacatcattccccaaaggtccggtaaaatactctttctgctctctggctgttttggcggccagttccacataatcctgcatattttcctgcatctgcacattaactaccttgaataattcactctccgtatttaaatatgtaaatgcggtatcaatcttgtcaaacaacacaacctgcccatccaaaaaacggtatctgaacgcttctatctcattcgcacacttacacacagcatacaccatagcaagggtaaaagagtatttctgctgttttacctttttcaaaaaattcgtaacatctgcctcaaaggtcacacaaaaagcaggctcaacactactcctaaaaaccatacagtgcatggccctctcccaacttttttcatcaattacctgataatgattcaatacaattacacgctcctttctgatttcatttgtaagaaatgatattacaaaaataatagtttattcaatatcgaatgtttgagaactaaaattgctataaaaccgcccctgtcttgctgtaaaacgcaaaacacaataatccgggtcggtcaccccttccggataatacatcgtatccccttcctgccagatcatctccttataagaactatcttccagtacctccatagtaccagtcaacataacgccccggaaaaatcttctgtcacaaaaataaatacaagcctgtggattttttctatactgcgttaccctcatagaagaagtattggtagtaaaataaaacacctgaatcccctcccttttcctcggcggcagcatagccttcgtattaggaaacccttcctcatccacagaactaataaaagacacgccctgcttatcaatcaaattcccaatcgtttttaccggatctctcattttcttactttcctccttatcataatccctatcacaaatcaaccaaatcagccgcccctttaaaatccccttctccccaaaagttcccccttccatatactcattataattattaaccccatcaatagcaagcaaagaacctctcccttatcttgtcaatccaccaccatacgccccctctcatccctcccgcccggatgcaccaaagcgacgtgaaatgcgctgcggtaagcccttcacatacacacatggcggtttgaagggcttaccgcagcgcatttcacggagcgtcccccttcatcgaacctcaatcgtgaaagcctctccaacttgctcaaaatcattactaagtctcccgcttgtttccggatacttaaccgcatagggcgtcaatgtgagcgtctccgcctcatcgcttaaattcccggccgagttatcaatgacgaaccttccaccctcttcattggatgagcttacatagaaacttaccggatttcccagattatccgtaccctcaagcttcatatcatagtcatttttatttccgtcattggtataaaatattttctgtcccatggcattgctcgtatacttcgtaaatgtgatattacatccatccggcagctggtactggtatgtgaggtctatggtctgcgtatcagcagaaagctgttccccgctggcagtaaatttaaattcccagctgcccctgttttcctcataatcgctgaaccgtatggccacgttgacctcctggctcaattcagccagatccacctgattcagataatatttcatcaccacctcccgcgtatgctcatcggtagtgtaagaaccgcctcctgctgcgcccgatgccctcacgccattgatgtaaacatttcccattagccccggccctccttctgtgatagcatcttcatagacctctgtcgtcgaaacaacaagctcatccacgtccagcaccacagaattcagtgtaatcgttatcccgtcttccgtcacagactgattgacaatctgttcatacggcgccagattcttatcaatcccgagaaaagtgccgatccggtaggacaattgttccaccgcatctgccacagctccccgaagaggcatgactgtcaaaagggcaaaagctgctgccgcacatacacctgccataacatatttcttcttgccctttctgcgaaccctgccaagaacctttttcttaaccctttttgtttccagctccgaccactcttcctcctggaacgcatcggcctcagaatctatgtcatttaacaacatatatatattactcttcatattcatctctccttctgctctcttggaaacaagtttctgattttacgttttccacgggatacatgattataaactgccgactcctgcatgcccatctccctgctcacctggctgatatcctgttcctcaatataaagcctccgaaaaagctcctgatcccgtgggttcaggcatgaaagcatctgttccagctccctggatatctcctggtcaaccagcctctgataagcctcttcctcctttgctgcggccacatcctcaatattttccacttccagctccctgcggtgcttccgcaggcagtcaatggcacggtatcgtgaaactcccgcgatccagttcttaaaagaattcttcatacagtcaaaatattgaatgttattccacacctggaagaaaatatcattcatacattcctcctgatactgcggcaaagcataaagattctttctgacaatcgactttacaagccctccatagcgctcaataatataggcgagagccgactcattatgctgctttagctccctgatataattttcctcattgattttcataatctgcgtccttctctaaaattgtaagcttacaaaatatcgttacacctattattacgtacaaatatgagggaagtctatcagaaaatgaaaaatacttggaggaaggacgctgtgcggaattggaatatgcctctcctggatgcggaatctggatataagtgccgctaatcaaaatcggagccgccatggtgaacaccgcggacacttgcgggaattctgatgaattcccacttcgggtctgcttgttttcaggccttgtaggcctgaaaacagttcacatggcggctccgattttgatgaagcggcactaatatcctgaaagacacatccaggagaggcatattccaattccgcacagctgggttcatcctccgtaaggaaaaaacctttctgatgcccgggacttcgaggggggcggcgaattgagctggcaaccaaactctaccccgccgccttctcgaattgggagttgtagagttctgcatagaacccgcctttgcggataagttcttcgtggttcccctgttctacgatgtctccatccttcataacaaggatgatatcggcatccctgattgtagacagcctgtgggctatgataaaactggttctgcctttcatcagggtgtccatggccttctgaatctggatctctgttcttgtgtctacggagctggttgcttcgtccaggatcaggatctttgggtccgccaggatggctcttgcgatggttaggagctgtttctgtccctgggatacattgctggcttcctcattcagttccatatcgtaaccgcccggaagtgtctggacaaaacggtgcactcttgctgcctttgccgcttcgatcacttcttcgtctgttgcatccagttttccgtaacggatattatcccggatgcttccatggaacagccacgtgtcctggagaaccatgccgaacatctggcgcagctcgctccggttgaaatctttgatgttatggccatctatcaaaatggctccgctgctaacatcataaaagcgcattaaaagcttgatcatcgtggtcttacccgctccggtaggccctacgatcgctatcttctggccttcttttaccttggctgagaaatcattgataatgattctgttctcattgtagccaaaccgtacatgttcgaactctacgttgccctgcagaccttccacggataccggattctgcacggtctggtcttcctcctcttcctccaggaattcaaacacacgctcggatgccgctgctgtggactgcagcagattggctacctgcgctacctgctggatcggctgtgtaaagtttcttacatactgcgtaaaggactgaatatctccgacctcgattgtacgctttgctgccagataccctcccagtataacaactaccacataacccaggttccccacaaactgcatgatcggcatcatcataccggatatgaactgggacttccatgcagagtcgtatagtttattgttagtttcttcgaattcttctattacatctttttctttattaaatacctttacgatgttatggccgccatatacttcctccacctgtccgttgacttcaccgaggtatttctgctgtccgcggaagtacttctgggaacgtttcatgatcacggaaataaaaccgatggaaagcggaagtattaaaagcgccactactgtcatcagaggactgatcgacagcatcatgaccagcacaccgatgattgtcgtaacagaagtaatcatctgcgtcatactctgattcaggctctgtcccagcgtatcaatatcattggtcactctggacagcacttcaccatatgtctttgtatcaaaataattcatcggcattctgttgattttttctgatatttctctcctcagacggtatgtcattttctgggaaatgccggtcatcagaaagccctgaacaaaagaacacaaggcgctcactagatacaggctcagcgtaaagatcaggatctgaccgattttcccaaaatccatgccactgccgccggacactttgctgaccaggccgttgaatatctccgtagttgccttaccaaggaccttcgggccaatgatgttaaagatcgtaccgccaatcgcaaatacgattacgaaaaacagctgtattttatatttgctcatatatttgagcagtttttttacggttgctttgagattctttggcttctcacctggaaccatacccttcatagggccccgcctgcccataggccttctgccgccttctctactcatggctgttttcctcccttcctttcgtgtctgactctgctgtctccatccccgccttcagttcttcctccgacagctgggatgccgcaatctgctgatatacttcacaattcttcagcagctcccggtgtgtacccttccctgctaccataccatcgtccaaaacaataatctgttctgcatgcaggatcgtgctgatacgctgcgcaacaatcagtaccgtgctttcttctgtcttttccttcagagctcttctcagtgtgacatctgtcttataatccagcgcagagaaactgtcgtcgaaaatatacagatccggatgttttgcgattgccctggctatggcgaggcgctgtttctgtccacctgatacgttcgttcctccctgtgaaatcggactctcatatttctgggctttttcttcaatgaatcctgcagcctgtgcgattgctgctgcctcttccatctcctcatcgctgccctccgggttcccatacataatattagaagcaatgtcgccggagaacagtacccctttctgcggcacatatcccagcttatcccgcaggtcatgctgggttatatcacggatatctatgccatccagggtaatacagccttctgtaacatcataaaacctaggaatcagatttaccagcgtggacttgccgcttcccgtgcttccgatgatcgcagttgtctcacccggcttcgctgtgaaatcaatatcgtggagcacatcttcgcttgcccccggataacggaacgatacgtggtcgaacttcagaacgccttgcgttttttccggcagttccactgcttcctccggatcatgtatcatggttgtgcttgtgagcacttcatctacacggtccgcagaaacggccgcccttggcagcatgatggaaatcatgcacagcatcaggaagctggcaatgatctgcattgtatattgaataaacgccatcatatccccgacctgcatctgtccgttatcaacaccgtgagcgccgctccagataatcagaacggagatgccgttcataatcagcatcatagccggcatcataaatgtcatggcacggtttacaaaaagggtcgttctcgtcagatccctgtttgccttgtcaaaacgctcttcctcgtgcttttccgtcgaaaatgcacggataacggataaccctgtcaggatctcccttgtaaccaggttaagcttatctaccagggtctgcagaatcttaaacttcggcatagccacggtaaatagagccagaactaccagtccgatcaggatcaccgccagtgcaatgatccaggacatggatacattggtatggaatactttataaatgcctcccacggccataatcggtgcatataataccatccgcagcagcataaccatcagcatctggatttgctggatatcatttgtgctccgtgtgatcaaagacgcagttgagaaatggtcgaattcgttgttcgaaaatccgacaacctttctgaatacctttcccctgagatcacgtcctgcagttgcacccacgcgggacgccatgaacccgaccagaatgctggctgccatccccaaaaatgcaaggcctaccatcttcgcccccgtggacagcaggtaactgttctgcagtttatttgtatccacgttcagccgtgcgtatgcatccttaatgtacactttggcagcctggtctatcatagtcgccggcatgtcggaaaatttatcctctatctgcttcgtcacctcagaacgctgctcctcaggaatcattccaaacatttcaaacacatcggcttcatctatctttttcagctgggcgtcaatctgttcttttgcctgcttctgcatctcttcctgctgcttctgcagttcaggattcattgcgatagccgccttctgctcatccgtcatcttggacgcggccttatccatctgcttctgtgcctgctcctcaatcatagacttcatcttatctttcatggagacttccatctggtcagtcacatcgtttccggattcaaagccggacacaagcatcattgggctgccaaggatagaagacagtttctccacctgcgcttcctcctcttctactccactcttcaggacatacacagaaccgtcatagtcataccctgtgtccttttccttcaactgataagctgctttcactgtatccgcatcttcgctgcccacaaaaagcagaagcttatccatatcatccgccgtaactgctttcggtatcgattcgtcaataccgccctgctgaatcccgacatttacaatgtccgaagtatatccaggcagcgacaagtcgcagtacgcctgtatgatgaggactgccagaatcgctataacggctttccagtacatccccatatacttaaatagtttcttcataatatctccctttctgcatatacttttatgtctgtcattttaatccggagagttctttttcctcttttaaattcttctgcatctgaagaagaagtcttctaagcagcagcttctcctcctggctcatgcccttaaacataagttcatccatctgcttcgccacttttttaatatgttccaggcatgccttccccttatcagtgggactcagacgcataattctctggtctttatcatccggcttacgcctgatgtatcccagacgttccatcttcccgattgccgcggtaatagacggcggagtcacattcatcttcgaggcaagttcccgctgggacatctctccaaaatgttccagcataaagagaatccccgcctgcccaatctttaaatcatactcatcaaataacagcctggcccgattcatgctcatatgcataatctggctcataattcctactgtgggaacatggttgacatcacaattcatacaaatctcctttcccggaatccttatcccaaaccccaaaattagttagacgtttaacgattatattagtagtattatatagaaatgtcaatatatggttcaatatttcacatttttttaataattatgcatcacaattaattagttatataaattaatactataacagtacccaagggaaacagtaagctgacatactctttggcaggcataaaaagcccacataaagggcgggggtgaaaattcattgctgcaagcaattttcacccccgcccaaatattttttcacaaagcgtcagtctccggaaaaggcagaatgcctcccggaaggttcctgtcaccgttttccatacggcggtctccgaaccttcccggcccgcctccccaaaagtatgcctgccatcccaacaggaaatacaatagcaaagagcaggcccgccttcagcccccatctcgggaattgttccgccactacacccgttagtcccggccccgccatgcatccggcatccccagccagtgcaaaaaacgcaaacatcgccgttcctccccgggtacattctcttgccgcaatactaaacgtacccggccacataattcccactgagagtccgcacatcgcacagcccagcaggctcagaaccggaaccggcataaagaccgcaaacaggtagcttatgatacacaaaatactactgcccagtataaacttctccaaagggattttgtccccgcattttccgtagaatacccgggatgcccccatcaatgctgcaaaagcacagggccccagcaggtcgcccatcgttttcgatacctgcagactgctctctgcaaagtaggaagcccactgggacatggcctgctcggatgcaccggcgcagagcatcatcagtacaaaaacccagaacattttcatggaaaacagctttcttaccggcagcctttcatcttcctcaaccagggtacggatcggaacttttgtaaaaacaaatatgttgacaaatggaaccacggcccagataactggcaggtaattccagtgttccatcccgaatattttaaagcccagcgtggtcagtatcaccacgcccacctgcccgaagcagtaaaaagaatgaagaaggctcatggccttttccttctccctcgaaggtgcggcctccacaatcggactgatcaggacttctatcagaccgccgccgatcccgttcagcacaatagctgccagcaggcccagatagggatccggcatcacaaacgggaacaggcccattcccacaagccctgcggatgccatgatgtgggcggccacaatactgattctgtagccaatacggtccacatattttgcggccagcaggtcaaccactagctgtacgccaaagttcagtgtaatcaggaaaccgattctttccacagatatatcgaactggttttgaaaggtcaaaaacagcagcggccccaaattattaacgattgcctgggtaatgtaccctgtatagcaggcataaattgtttttttataacttttcatgatctccatatgctcagaacaggggggatgcaggttactatgcacgcctcctgttatcggtcctttctattctgctattgcttttttcttccaccgtccggcgcggtagcagagaactgtaatacacgctcccagtatccatgagatcagcagggaaataaaaatacatgcactgtttccgttcggcatggaatcggatctggtcagccacgcgataccataggccagcggaacgcggattacaactgtggtaaccatagaaatccacatcggcgtcacggtatcccctgcccctctcattacacccgacagacactgggtcacctccatggcgatataccccacagccagtatcttcatcatggaaaagcttaattccaccagttccggtgtggaggtaaatatagacatcaggtatctgccgaacagcagaatcaggatggtgatcgccgtagatgttccgactgctatggcagtcccctgcttagccccctgcacaacccggtccatccggcgcgcgcccacattctggccggaataagtggtcagcgcggttccaaaggaaaacgccggcatgactgcaaacccatccacacgcatcacaatcacattggcagcgataaacatttcaccaaagctgtttgtcagagattgtacaatgatcatggacagcgaaaaaatcgcctgggttaacccggaaggcagccccaaacgtatcaggccccacatatacttcttctccggcacaaggtattctttcttcatatcaaatacctctttcatcctgagcagcttccgcagagataacagcgccgataccatctgtgcaatcacagtagccagggcaactccagcaactcccatgttaaaatacgcaacaaatatgtaatccaatacaatattcaatacggtagctacaagcagataaacaagggccgagatggaatcccccaaacctctgagaatcccgcccagaatattataaaatgcacacccgataatccccataaatagaatcataaggtacgaattgcaccatccgataatcgtatccggcgtattcaaaagcctcaaaagcggcattgtgacaatcggcgtgaccaccatgaccaggatcgttgtaatcacggtcagggtaatacagcagcctatcgttttagataactccagtctctgtctggccccaaaatactgggacaccatgatccccactccgaccgaaatccctacaaacagaaccagcagcagattgagaatcggccccgcgctcccgactgctgcaagggcattatcccccacaaatcttcccacgataatactgtccaccgtgttgtacagctgctgtgcaatatttcccatcagcataggaattgtgaatgcaacaatccgtttccacggacttccctccgtcatatctaccggggcaaataattttttcatacctgttaacataaggtaaccttctctcttcatcctctataattctatataaatcaaacaattacagtatataagatttctgcttgtattaccagcagattatatcaaaaatggagccattgctccagtagattattcatctgctgaagcaacagccccttaaaagttactgttcagaccgtgctgtgcattcactgcacagcatcggattcacagcgtaatacagccaatgagcctgcccctcgccgaaagcggctttaaatgggaaggcggtgttactgtttactgacttgcctgtgaacagtaacccttaaaacagatatctcagatgcaggtaaatgccccatctatcaccatattcaaaccagatgtgtagctggacatatctgacgcaagatagattaccgctcccgcaagttcttcgggtgttcccattctgccaaatggtatcattccttcccagagctttttccagtcttcacgcacactctccgtcatctccgtacgaatatatccgggactaattgcatttactcttatccccttatcagcccattctaccgccagggatttcgtcaaatgcataaccgctgcctttgatgcattataggaagattgcagctgtggaacattgacaatgactccagacatagaagccgtattaataatagaccccttcttccctttaagtattaactgttttgcaaattctctcgccatataaaaaattccatttaaatttacatttattactttttcccactccgctggtgtaacttctaaagcactcttatgtaaacaaatacctgcattattaaacaaaatgtccaaacttcccatctcttttgcggcttcattcataacctcttttacctgctttgaatctgaaacatcacatttaagagcaattgctttcaccggatactcagaagctatctttcttgcctcttgttttgcatcctggatatccactattacaatatctgctccctgatgggcaagatatcccgctactatctttcctattccctgactaccgcccgttacaaccgcagtttttccttcaaggcaaaatgaaatttttgtttccacttgttttcccctcctcactatttattccaattttcgtcctttgccgcctttgcctgagtttcccgtcttgcatcaatccgctccagtacctgctggggtgtcatatcatcaataaacatagaaaccatatcctgtcccaattccgtccactgtggatttaaatacttaatcgaatcttgaaatactgttccagctttttcgaaagaatctaagaaatcctgcgtatactgactataagatggtgtctgtcccacttcgtaaggaaggttttcaattttcccttcattatctatcatatactgtatactttctttttgtgtgatatactccaagtactgtttcgcctcttctatatgtttggatcctgaataaataaatctggatggtccgcacggatgcatattcagtacatcgttatccaaagtaggtatcaagaaaaagccaaaatcctcttccgtatatgtcccattagacgctgctacgatttcagccaccgttcccggcttgcacattgtcattgcaaattcaccgcttcccaatgccgacggcaaatctgtatactcatctgaaagataattatctccaaaatatcctttatccgcgaggccctttacctgttccaaaacaagcttaaattcaggaatttcagcaaacgtagtttggttttcattcaactggttaacaatatctggatagatatcttcatattttccgcctatctcgcagaaccacataacatgatgccagccatctccacagggctcaaaaaatggcagcactccattatccataagaacctgacagttggtctcaaattcagcaaaagtgtttggttctgtaagattatatttttcatatatctttttattatatacaacataaaaatccacactgacatctgtatacgttgcgccatatagcttgtctccaacagaagtctgttcttttgcaaatttatcgtatgctgcaacccatggttcatctgtcagttccactgcatttttctctatattgtactgtgatacgagatcaaacgttccagattgtccgccaaaaatatcaggtccttccccactgttaagttttgtcattaaaagactgaaatattgatcataaggaacaatctgatagtccaccttaatccctgtctcttcttcaaatttacgccccagctctttttccgcatcataaacccagtcctgactggccataatcgtaagggtaacatcggaagatgctttttcctgttctgtcacactgttttcattctcttttttgttgctttcagcttccccgctgttcccacatccaaccagacagcctgctaatatggccagtactaataatacactcatcattcgttttcccataacttaattcctcctgttttttctaaaatacctttatttaacttctatatcaaatgttcctgctatgttactccagttgctttctgcataagacaaaagtgtcttaccctgctccatggacatttccgggaaatcgaaaaacagcccggccgatccatacttttttacgatcctttccgcattttttatccagtcttcaaattcacctgtgtagacctttatccacaaactctttccggcttttctcactttgtcataaatctcgtcccactcctccattgtaccatctggagcggtatccccgctgctccactgtaaagcatcaatttcttcaatttccatcaacgaatccagatgtctgattgcatctgatccatctaaatgatacaacacacaatccgccttttgagcctgtacgcgcagggattcctgaataaattcacgaaaattatccggtgacaacatagcctaaaatcacactgcagttttacagtcctgcccggtccccaaatttgaaatactgcgtaagcattgcctccttcctcttcttttatttcctcataaaactgattaaaataatcataatagatattagtaatttgggtgattcgatttttaataagctcaggttcatcaactaaatcaaaaagtgtattttgtgcgccccgcagagatgcaattacatcaatattttccattatatccggcattggaattaaaaaatctccatttgcaagttccttacattgttttaccaaatttaaatgctgacggaaccatttactatttggccgaaacagaaaatcgtctgcatcttcccattcttcaatgcaagatttataccatactgtatcttcctgaaaacaaatctccgcccctaaataagaggccattgctcctggcccaaaatccacatcaagattaggaaaactttcacctaaaaatgcatgagtgtcacaaaattgccgatatctctctaccattctttctgctgtcaagtatttatcattcatgtctgtatattttaaatgctccggaagattataatactttccctgacagtgaacatccttaatagttccctgtaccggcctttttcctgaaaattcttctatctccggacgtcttacaatgacgttcattaatggacgtccctgattcttttgtttccaataccctgcccatttttcttttgtttcttcccaattctttttatacttcattttatacctccgaaagtgtaacggtgaccttctcccccctataggtaatttgttttctctgttcccccaggataatttctatactgcgtcctataattccctgagcaaatgtatactctgctgtccctatagtcaaactatgttcaaaatccttccattccatggttattatattataaattcctttttcataaccatatccatccccttcatcctcataatattcataaactgcatcttttccaggataaatataaagttgtagtggggtaaaaattttctgacctgtatacatcattttcttttccatgggcagaacggacccggcccgtacaaacaatggaattttatctattcctgattccacattcaccatcgttcctcccggatatctctcatttccatcaaattcataccattcactcccgccaggcaaatagcagctccaacttttacatctgttaattcttttcccttctttttcataatacataggttttgtaatggggcacaccagaatgctttccccaaacatgaattccgtttctatatcccttgctttttcatcttcatagaaatcaaaaagcaggctgcgcatcatggtctgattcctgctgtatacttttcctgccatagaataaatatacggaagcagccgatatctcagttcaatgctttttgcaattgcatcatagaaaatttcccctttctctccaaaattccagatttcccgaggtgtatctgttccatgagaccgaaatacaggaagaaatgttccatattgcagccagcgaacatataactcccgataccctgcgtcagacaccccttcttcatatcccccctgccagaaccactttggcagcggatcactctgacgattgcatccccttttttcccagttctctttcaccacaaaaaaaccaccaatgtctaatgtccaataagggataccgctcatacacatattgagcccttcttttatctgcttttccaacgtatcccaggtggcacaaatatccccggaccaaagaactgtaccatatttctgagaacccgcatatccggagcgggtcagattcactactctcctttcttccgtttctaatctctgattttcaaaaactccttttgcatgtgccactgcaaaaagatttgccctttccgctcccaagtactttttatgctcctccccgacaagctgatatctttcccacggttccctgagacagcctccatcccaatccggagcagaataaggttctgtggaatcgcaccaccagccatctatgcctgcagagtacaattctcttttcacttgactccaataagtccgtctggcttcctcagaaaacgcattgtatgtagaaaaatcatataagagctgttttttctccaaaaattcctggttattcttcgttcccaaattcatatttggccaaatagaaatcataaccttcgcatgcatctcatgtatctgctttacagcctctgcaaaatccggatatctctttttgtccagaatcttttcaccccacgcatccttctcccaggtattccaatcttgaataattccatccagtggaatattccttttccggtactcggcaactgtctgaaccaactcttcctggttatgataggattccttggactgtaaatagccaaatgcccactttggaagcattgctgcctttcctgtcaaaaaccggtatccatcaataatttcatccagattctttcctgagatcaagtagtaatccagctgctctattgcatccaacattaggtaactgccgcgcgcatcatcattccaaatcatcagggaaccacaatccactaatacaccatagccttggtcagaaatgaagaatggcacaggtatccgcatattatgctgataaagatactgggtgtttcctctgtagttaaaaatcccctcctccccctgtcctaaaccatgaatacgttctgttttcttaaattgaaaatgtaattttccagaatacccttcctgtttttttaagggccgcaggttcttcaccatattacgttctccatccaccgtatatatacgctctatatcaggttggtcccctaaaatcccatattcctcaaacactttttcctgtagttctttttccttttccgccagcagcagacaacctgtttttctatctatccatctgaattttcccgtgtccttttctatactaactttcaacctttctgtgcatatctctatttccttcagatggtttctgacgtctatatcagcctctgcatgcgcttctatatccaaaggtgattcttgattcatctctgcctttttgtgaaatacacagcgtataatattttcttttataccctgcaaaaataaatttccctgatttgtttgaattaatatttcttttcctttcttttggaatttcctgatttccataccctttcctctctttcacaacaattctgtttcccgacattcttagccctttaccgctccggcagtttgtccccccacaatataccgttggcataacaaatacataataataacaggcaggcatgtgagtaatatatcggcacatattaaattccagcttttctcaaactgcccgaagaaattatagacggccagtgtcattggccatttctccgaggaatttaagaaatacaatggcataataaactcattccaatcatttaagaaacataagacacctgcagtcaccatacctggctttagcattggcataatgatacttatgaaaagccttatggggccgcacccgtcaatcactgccgcctcatctaaatcgacaggtatcttgcagacaaatccatataaaagaaacacagtaaagggaagctgtgtagctgtatataaaagaattatacccagggcagtgttattcatctgcaccatctgcataaccttcatcaatgccacataatttataggtattacaatcccaagtactaaataaaagtatacaatcctatttttccttccttttctccttgcgaagaaataggctgccatacttcccagaaatattgtaatcaacatggctgcacctgcataaagcaagctattaaaaaagctttccagaagttttccctgcttaattacaactgcaaaatgctcgactgtccaattctttggcagctgcagagaaagagtatatgtttcctcgaccggtttaaatgcattgactaaaatcaacagcaacggtattatcatcgtaagagaaaccagccaggcaatcagattttgcattacgctctttaatctctttttgctttttgcccccactattcatgcacctcctctcgtgtaagaaactgaattaaaaacactccgatgcaaaccatgaatataaacataagagaacttatagtagtacctaccgcatacattccctgggaaaattgtttaaacactgctgtatacatcacctctgttctatgtccgggccccccgttggtaagtgcgtataccatatcaaatacttttaatccgtacaacacattcaggacaatcgtaaccgccagagtaggtcttaataagggtaatgtaacatttttaaacttactgaagcttcctgctccatccacaccagccgcttcataataagactctggtatagccaggatccctgcaattaaaatcgtcataatatatccggtcccgcgccatatatccacccccataactgaccaaaatgcaattttaggatctgtcagccatttctgagtcatactctctaacccaatcatcctgagcatttcattcaatacacccgttttaggatttaatatggaggtaaacaccagaccgataatcaatatagacaatactgccggcatatacataatacttctatgaaaattaatagctttgacccctttactgagtattactgccagcagcagggctaatactgtttttatcactgtagtaacagccgtaaacagcagggtattgccaatataccccatataattttcgttcacattaaagatgtttttgaaattatccagccctacaaagttaactttttctgaatacgcagaccaatcagtaaaggaatagccaattccaagcaaactggggaagacatacagaatactatatatcagcaatgcccccgctgcaaaataccatgggtaaatcttgttgcttttcacaacgcacccctcctttttcttatttatttggattatattacatactccccccttttttacatgtatatttcccgttactttatgccattttttaaccattcatagattttgtttatgcattatgctataattatcaaaaacttagagaaagaaggatggatattgaaatattataataaaaagggtattcaaaaaattttattttccaatatcctttctaccatgcttattatcctaatctgcactactgccattttttccgttgcgctttacaataatatgaaaaacaatgtgattgacagtctgcagcaaacctgctccgccgtctctaaggatattgatttacagctacaccaattagataccgtgtgtatcaatatcctttattccaacttgataaaaaatacatttggagagtattccgataccaccagtcactcctcctatcaaaacaaacaatatgagtccacactttcaggctatctcacctctatccgaggagtctacagcgatattcgccagattaacttgtacagcttaaacggtgggtgctatggtaccggaaattttatcggctatcaagatattaatgccagcctgcaagaatggtatctgcctaccatagaagcaggcggttcccgctatattcctactgcagcaaaaaatgccttgctttccaaaagtgcaggcacaaatttagatcgctactatctttccctttaccgcctttatttcgataattatcaccagccacaggggattattgaagtagcacaatattatgacactctatttgagcgtgcatatcatttagaaagcagctacaatattaaaattatgatatacgactctgatggaaatcttttatttcctattgtacaggaatcgactcaaccttttccttacttcaaatttcagacaacagactccaatgtaatagaagaaagcatcaatggcaagaatgaattaatgtgcttttccaatatggaagaaatggatttcactgtagttgccgccatccagaaaaatgaactgtttgcccctatatacacttctttagccacggtaatgctgttgcttttggctgctacgcttttctgctataagatagcacttgccctatccagacgtctcagcgcgccattgacggaaatgtatcattaccttacaaattccgagggaatcaatcaacaaattgaacttccactggaaaactccggagttctggaaatagatgccttgaaagattcattgaagcacttccaaaaaagacaaaaagaaacgattgattccatgctgcttttaaaggaacaagaagtgcagtcacaaatgcttgccttacagtcacaaatgaatcctcattttctctataattctttatctacaatcaatgctatggcggaagaaggtatgaacgaagaaatcagtgtcatgtgtaataatatcactgaaatattgcgatatatatcctctaataaaaagcaagtcacatctttggaagaggaactggaacattgtactcactatcttcaatgcctgcaattaagatatgaaaatgcattatcttatacaattgacgtggatgatgaaatgttagaattgcctattccgaaactctgtacacagcttcttgtagaaaatgccgttaaatttactaccaaaactactcctccctggcacatttcaattgaaggacgcagagacaagaaccagtggtatgtatgtgtccgggacaatgggccaggattccaggaagatgttataaagaccttgcataagcaaatagatgaaataaataaaaatggacttttaccatgtctggaactaaacggaatggggctattaaacatttatatacgtttttatctaatttaccatgcagtctttatctttgaacttggcaaccaaaaaagcggcggtgcttttgtaacgataggaggaaaaaccaatgaagaagctctcaagctttaatattatgctggtagaagatgaagccttgttgatgcggagcctctcaaggcatatagaacaactgaacctgggataccatgtagtatcccagaaagaaaatggattagatgcgttaagagctatagaaacctgtgatccccacgttatcatcacagacctgctcatgcctgctatgaacggactggaacttattaaacatgtacatgctaaatatcctcatatccagactgtaattctctctggctatgctgagtttggatatgcgcaggaagccttaaaatataatgtatctgattatttgctaaaacctgtcgagcaggataaattagatgactgtctgtcaaaaatcaaaataaagctctgccatacctatgaacttaaggaagatttgacttccaattatcagcatggagagcagctcgctgaacatatatgcttatatttccgtgaacactatatggatgatatagatttaggcattttggctcagaagtacggaatcagttctgcttatcttaccaaaatctttcgaaaataccacggagacactcccttaaagtatttaacagatattcggatttttcatgcaaagcacctattgcgtaatacagaacttaccatcaaagaaataagtgagcgcgtaggatacacagaccaatttcattttagccgcgtctttcacaaagtcactggaaccagccccagtattttccgaaaataattttcaggcgggaaagcagcttaggatgaatttcgtttgataggagataaacttttattcgtatagccccaaactaggaaaaagaatattaaaaaggaaaagaacatcctggcaggaaatttccatgatgaggaaatgtagagtcccgtggggatgttcttttttgtgggtaaggggttaaaaatcggcattacccggcagcctctgtgaacttagatacgaattattctttactaattgtcaatttttattaatgatagataaaccagcgtcttctctattctttgtccatcttcttataatatatgtctttattcagcacgccttccttgaagtttatgatcagattcgtcgccgcatctccgattacgttcaatgtaataacagccatgcccggcagataattcatcgcgagtacaagagaatatccgatcatgcacaggtcactgttgaaccccagtccggtcatgaccacatataccattgtggtaccggccaccgggattgccggtgttcccattgccgtgcagatagataggaatgcagcaacaatcagagtcgaaggcttgatatcgattccggcagccgttgcgataaatgtcactgcaatcatgtgcatcgcagttgtcccgttcatattgaccgtcattcctgtaggtaggacaaaactgctgatttcttccgtacatcccagttcatccacacaggttcttgtattcagcggtaatgttgctgcggatgaattggttgctgctgcaaacaatccaactttaaatgttttcttcatgaacggaatcggattcatccgtgttgtcagcatgattccgatcggataaatcgtaactaccagtgccaggctgacaacgatcgttgtcatgatccacaccagcgtgggaccgatatattcaatcccatatactgcaagggttcttgtaatcatacagaaaattgctatgggaccggcttcatcaatcagaaaatccagaaatcgctgtacaatctcgtttaaattctcaagaacctttttcaatggctctgcctttttccccattgccgtcatgcacaggcccatgataatggcaactactactacagacaggatggaactgttagatgagaatacggaaaagatattagacggcacggcatttacaattgtgaccagggggttatatccttccatggtgaccgcctctgtcaccatctctcccggaagctttacatcaaaccagcccatacttttcacgaaataggccgccgctcctgcgagggctgcagccaccgcatagaaacagatatatgtaataaatgtctttcctgcaatcttgcctaggcgctccggatctgccaaactgcagagcgccaggctcagagaggtgatgaccagcggaacaatcgacatctgaagtccccgcataaatacctgcccgataatatagaacagcccgattccttcgattccgtctgtcgccgtgatatcctgaaagaaaatggcatgaatcgtattccagacatcactgtttccatttccaagcagaaattctctcagcagcagacacaaaaaaccggcgcagaatccgaacagtactgcaaacatcatccgcctgatgatcgacatttttttccttctcttacccataaattccaccaacctcttccttctttgtttttgctttacatcgcttctctatttttggttttccaagaacgtctccggctttccctcccaacctgtattccccgttatcaagaagaaagaaatgccggtttttagggatttactcatacttttaaggttacgcgcccctgtctttgatctacttttattttacattttatggtgattaatgtcaacatcatttctgtgtttcaaatatttttagttgttattcacaacttatctatcctatttttatgcatatttttgttttcgaagcaatttattctttgtttcaaatatttttacagtccatcgagtccataacaaagaaagctgcccaaaatggcagcttttctaatggagtttgtttcacagtatagccgaaaactcatgtattcagttttagtttatgggtgtagtcattaatatataagctctatcccgttctccctgcagtaatgtatccagatatcgctgggctgtctgtctgtgataatatagtttacactcttcagatcaatcaggcatacgaatgccgtctggtcaaacttggtatgatccgcaaggagggccacctcatccgcctgctcaagcataatctttttaatctccgcctcgctttcattggagtcctggacacccttttcaatatccacgcttttgcagctgattagggccacgctgacatggtatttggacatgttgctcttcgcaagctgtccctggagagacagcgatttcttattaaattcgcctcccacggatatgacatttaccgcggactgctgaaattcacggaatacttccgtggagttggtgacaattgtgacatccggattatcctgcatcagcttcagcgcctccataacggtggtgctggagtctgcgataatcgtgtgctttccctcaagcagctctgccgtcttgcgggcgatattctgtttttctttcagattcttagacattctcttataaaaatgaatgccttccttctgtacatccgcattccaaattgctccgccgtggatcctggttacaacgccctcggcttccagcttatccagatcccggcggattgtctcttccgtcacggagcactgactgctcagctccgcaacagatactttcttcatattctgaatacattgcctgatgaccatcagtctctctctgctcgacatgctttccttcctcttctcattactattttcagtgcctgttttctttaataatatacccgccacttgagttttagcaagagttttttcctttgaaagcatttttttctccttcgaaccacaaattatttcttcgaaatgcgcagtatcggctttcggggttctcctattgatcaatggcttccgccattgcacgcattctgagcaggtcggaagcggagatctggatgtctgccgcttttgcattaaccgcgatctgctctgctgttgtagcgccgctcagcaggttgatgtgcggtccctggttcatgatccatgcaagtgcaagcgtcggaatattgcaattgtatttttcgcagaatggtttccagtcatccatcatatccatcgccttctgcatgttccccggctggaaccatttcttgtttgcacgggcgcctgtgggcacatagtctcttggaagggttcctgtcagaagtccctgctccagcggggaatatgcctggagtgttacctgatgctctttgcagatcggcaccagctcctcctcaactgcacggtcaagaacactgtattttccctggacaatatccagttctccgtattttacgtattctgcaatgtgctcttttgtcacattagcagcaccgattgctttaattttaccttccgccttcaactcattgagcacttccatcgtctctgagatcggggtaaagaatggctctactgcctgccagtgtgtcatatatacatcgatgtagtctgtctgcagccttctcaggctctcttcgatctcctcacggatggattccggtgacagatttttatacagctgggtgtctccgaccttgttgaacagggcgccctctcttgtccatacgatgccacattttgttacaaggcatactttttctcggtctacttcttttaaggctttaccgacgataacttcactgtttccaaaattatatcccggcgctgtgtcgatcaggttgattccgagatctactgcctttacgattgtgtcgatacagtcgcgctcatccaggtcgccgttccacgccggacctccgccgattgcccatgtcccaagacccattttggaaatctgtgtgcctgattttcctaactccatatatttcatttttctcaccaatctttctgaatttctatatgttataccttattctgcagctttgctgcagacccgcccgaagggcatgtgttacggggtgccccttgggtattctctattctgctgtctgtgatactcttccagccgcgcatccacctgcgccctgttcttcacacctgttgtcgctccaatactctggacactgatggaggcagtcacatttgcaaattccgcacactctttcaggcctttgccttccaggatggctgtaataaagccggatgcaaagttatcgcctgcgccgatcgtgtcaatcgccgttatgccctgcattgcaggaacctccaggatactgccgtcccggctcttgatgaaacatccttttttaccggtcttaatcacgacatgcccgattccacagcccagaaatgtatccgctaccttattcagatccgtctctcccgtcatcatgcaggcttcctcgtagttcgggaagaaataatccacatagcccagtgcttccctgatatcgtccagcgtctcgccaagccttgccttgatcatatctgcacagataatcatgccctgtttctttgcttcctgaaaaatccgcaccagcgctttacagtccagaagaggattattgaaaatgctggcgagtgagagcagccttgcttcggacagtttggaaaggtccacatcatcgatggtcattttccataggcttccatttcggtttgtaacaaatgtccgttccccatcctctgtcacgagccctacattgatggaggtatcaacgccttccctgacccggatccctgaatcgtcaatcccgttcttttggcagtgttcccggatgaaagcgccgaccgcatctttgccgaccatgctcatcagcccgatcctgtgtccaagccgggacatgattgtggcctcgttaattgcatctccgccgatcgtcatagatatctgttccagcggatatgactctatctcaaacatatctctgcataccggccgcagcgggatatcaacaaccgctgcacccacacagattgcatccagtcttttttccacgttttattccgcctttccgtcgtctccaaacagatagattttctccagtgcacgctgttttactgccgctcttaccgctctttccacctccaggaatggtttttccacatttgccgcaatggcagtcatagctgcctggcacaattctgtgtggatgttgatttttgcgattccaagggagatggccttcttaatatcctcgtcgccgattccggaagctccgtgaagtacaagcggaacggatacggcgtctcttactttttctaccacctcaaagttcagctgcggctcagaagtataaaccccatgctggtttccgattgctactgcaagggaatcgcatcctgtgcgctctacgaattctgctgcctgggagggatctgtgtactgatagcttgccagcgcctcctcatataccgtctcatttcccacgtgtcccagttccgcctcaaccgggattcccagtggatggaaatagtctaccacttcttttgtcagtcggatgttctcctcaaaatcatatgcggaagcatctctcatgacagagttcatgccatggttgtaggcgttctgtacgatctccatgctgcggccatgatcccagtgcgtaatgaccgggaccgccgctttctttgccatagaaaccatcatgtgggagaagtcctcaaatgaggtattccctacaaacccggttccgaaagaaatgatgaccggagccttggattcttctgctgcatcaataacacccatcagcatttccgcattccatacattaaagtgcggaattgcaaactttcctgcttttgctttattttcccaatatctgatatctgctaacattttttattcctctcttctcttccttaatcacacactttgactacgccttttaccatctctgttttcttaaccgggtcaatcgcttcttcgaatgccttctgaacatccttgtaatcatagatgttggtaaccatatcttttacattaaacttaccggaagcaatcgcatcgatcgtctgcgggaaattattgcagtagcggaatgcggtctgaatagtaacttcgcggttgatcttcagaaaatcgatcggcaccggttgggactgtgtgcccaccatcatgatctttccgccgcggctgacgatctgaacggcctgctgtgcagtgaataccgcgcctgccgcctcaaatacaaggtctacgccatggtccccgtatagttccggtgatctgagcacagcaaccgtatcctgctcctttccgttgattaccctcttcgctccgagtttcattgcaagatccagacgtttttcaatcacatccaccaccgtgatatctgttgcgccaaggctcttgcaggcctgcattgtcatcaggccgattgtgccgccgcccagaatcacgatgctcatgcctggctttgcacctccgagaattgctgcgtgcattccaactgccgccggttcaaccaaagcgccctccagtgtggtcatcccctccggaagatggtatgtccattcttccggatgggtcatgtactgtgtcagtgcgcctttataattcggctgtgtagccatgaaatcaacgcccgggcagatgttataacgtccggtccggcagtattcgcatgtatcatccggcacacccggctcgatcaacactttatcgcccactttaaacctggttacctttgccccgattcccactacttcacctgcaacttcatgtcccaggccgatcttctggttcgggtctttcggcgggataaacggcccgcattcgaatccgtggatatcggatccgcacatgccgacatactcaaccttcatgagaatctcatggtctttcggctccggaaccggacattcctgaatctcaaagtgtttcggggttactaagattgcttccgaatttttcatatgatatccttcctttctgtgcaaaggggtctgaccccttctgttattctacgtttccaatgtcctcaacagattcgcctcttgtctctacgccaaagatgaaaatgcatacagcaatgattgcagcaacgatagaaatcagtacaaacactcccgtgcttccaatggagcctgcaatgtatgtcacaaggaacgggaagaaaatattgctgacgcggcccattgcgttacagaatccggaaccggacatttttgctgaggtcggccacatttccgggacgtataccgcggatgcgtagcatacgtacatgtaaataaatgtattgaggaaaaatgtagttacaattaatgcggtcattgtggtctgctgtcctgtaataattcccatgacagccatagcaatcagcaggatcacccccataacgcgtctcggaattttatccatgatcagagatgcgataaagattccaaaaggtgcgccgaacagtccgaacatggtcataaactgtgactgtgatgtgtcataacctaaggaccttaatagggacggcatccaggtcatcaatgtgtactggatcgtattcatgccgatcagaacaagggaaccgacaatcgttctttttaaaagcttgcccttgaacagtgctgaatatggcagctgctttacctgctttgcttcttctgttacaggcggcagtttttcacctgtggatgcttcgatctctttttcaatctttgtcatgatctcatcggcttcttctaatctgccctgagattccagccatctcggtgattccgggtatttctttgcaatcaggatggatgcgatgatggaaagaacagacgggatcatgaactgaattctccagttcatcatatagctgacgcctgttgaaactattaaaaatgcgataccattacagattggatgcgcccagttgccgatgaaggaattccggctcgaccataccccgcggtttctgcccggtacatattctgtaaaaccggcgaacagtacgaccagaagtgcaccgagaccgaatccctgaatcagcctgaaaacataaagtacgtaaatatttggtgatattgcgccgcccaccattgcgatgatatgtataatttcatataaaaggatgctctttttccggccgatcttatcgccgatcggcccgcccaccagagcgccgaagagctgaccggctgtatatgtagtcccccacattgccagaagctttgttcccggctccagccagtggatctcattcaggaggatattctggactgctcctccgattccatttgaccagcagaccaaaagtgcaaaggcggataccagccacattttgatatgccaccctgaattcggaagacgatccagccttgcaccgatattcacattttttatatttgaattcataaccttttcctttctctatctcattcttttgatacttttttatattccgtatattcatgccgtaaaggctgctcccgccggcaggcgcctggaactgcctgccggatctctgaattattgatccaaaagagcgctttccacttctttttccatgattccccacgctttttctatatctttatctttgttccaaagcgccggcggtcctaaaaccacaacatctgccccggcttcatacagaggcccgtatacgtctgcattcatggagccgtctgcctcgattaaaaagtccagccccatctcctctctccattgtacaagagttctgattttgtcgtacatctggacaatcactttctggcctgcatatcccgcgtctacaatcataatcgtaactttggaaagcagcggcaggtaataccggattgcctccagcggcgcggcaggattcattgcgattcccgccttgcagcccagggaaaggatcttgttaatcgtgacaaacgcatcgctctcaatacagtccgtatggggggtgatataggctgctcccgcttcagcgcaagcctcgatgtaatcctggggatgttttaccattaaatgtgcgtccatgggtgtatggactaccttccccagcacggtcataaaatccggtcccacgccaaatgtctttacataatttccgtccttgatatcaatatgcagaaaatcggccttttcgtcgatgcagcgtacctggtgttcaaaatcatataagtcacagcatcccatggatggtgcaagcagtaattttttttccatattcactcgctctcttattctccaactaagttccatatgttctttattttaacccttatttaatcttcaaagtcatagtggaaaattactttgatcgcttctttatctgccatagccttaaatccttcttcccactgtgaaagccccaatctgtgggtgatcatcggctgtactttgatcattcctgattccagaaggcggagtgcattcctccaggatgtggagtcatatgccatgtgtccgataatgctcttattccaggatgtaatatcgttgatggagaactcaagcggcttgaatcccatgcctacacggacaacctcgccgttcggacgaagcatctcgatagcctgcttcagtgcgatgttggcgccggagcactctacaaccagccccagattgtctcttccgcagatctcggtacatctcttcacgacatcttctttggatccgttaactacatgtgtggcacccagttcttttgcaacggcaaaacggacttttttgtcttcttccaggccgaccattacgatattgactgcccccatgatccttgcaacctgtacagcgaataacccgagcggtccggttccgaatacaacaacgtcctgtcccggaaggagatgggcctgctgtgcgattgctttgtaagagttacagatcggatcgagtactgctgcctcttcatatttaacattctccggaatctcccagattgcatgtttatgtattctcaggatctctcccggaaccttgcagtattttgaaaagccgccgccccaggtattgttgtccagtccaaggttcaccttgttctcgcagcagaggaagtcgccctgttcacatgccgggcagacaccgcatacatgggcgctgttgtcagatactacccgctgtccgaccttccagtccttcaccagctccccgaccttcacgatctcgcctgcgaactcatgtccgcggatggaattgaattcatcggaaccgttgtccactttgtaatgcttcatgtctgcaccatagattgccgctgccttgatctcaataataatgtcctccggtccgcattcaggctccggcacatctatcatccgatatccaccaaactctttaccataccttgctaacgctttcataattattctcctttttataaacatatattttattgctgctttgcaaaatctgtttccggccggaaacgttgtttcttttgatttaactaaattttacacccgtcctttgttttagtcaatcattttctgtgttttaaagataaattcgtcattttatacagatatcactaccgtttcaaatgtataactcctgttttatcgtctttaatcttgtgtatttttacaaatatctttgtttcaaagattttttcctagtttttattgaaatacctatactttaagaatcacattttaaatttttttcgttaaaagttaaaaagatcattttccctctgcttcatactgactcaggaaaatgatcttttattaaaaggggtctgacccctttgcaggatggtctgtcctttttattcaattatttcataatctagatgctggtactgctcataccaatattttctcactattgcatcacaaacagtacaagatactgtatgatgaaaaacagcgcaagcccccatgcatacttgtccatacagcccggaagatctccggccatttccgggttttctttcatttgaagccgaatttcaagccggcatcccttcagcgtataggtatcggctgtctgatccggctgtcttttatgaagtatactggccagatatccgattcccatagtaagtgccaatcctgtcacgttataccagagatagttgaccggaaacagccgtgccagtatcacagttcctgccacacctgcgaagaaccctatagaaaccccaaaatcatttgccttttccgtaagcatacccagtaaaaacatcccaagaatcgctccgcacagatatgaaatatagcttcccactgtagccagtatggaggcggtagtatccatatatgcaaaggaagcaaagataacgataataacggccattgtcagtgtaaagtatcgcgaaaccttaagtgacgcctcacgtttcccttttaatacccttttttcatagatatctttaataaatacagttgccatagaattcaacagggaatccacacttgacatagctgcagcgaaaattccggcaataatgcatcccatcactcccacaggtacctggtctgcgataaattgaatcattacctgatttgtattcttaaatacttggccattatatactgaaaacataataaatccgattatcataaataaaaagtacatggtattcatcaggattccgctcgtcaaaagagagcgtttcactgctttcactgatttagcagcaaacatacgctgcacttgtgactggtcagccatataatactgcatccagagaataccgcctcccagcagggtcacgaaaaaaccgttttctgcctccaggctgagtgaaaagtccagtgccgtcagttttccagcctcccgtgccacctgaatggtgtcccaaaagccgatatctaaattctgcagtgccaggaaaacaattgcgaacagcccgccccataccactgccatctgaatagcatccgtccatatcacagccttgataccccctaaaagtgtataccccgtggatataatcacaatgagtactaaaatgaaacggatatcccaaccggtcagctgactgatgatgagtgatggaatataaaccatagaactcacctgaatcagggccgtcactaaaaaaccggcggccccaagaattctgctcttttccccaaaccgtttctgcagatattcataacatgaagtaacccggatgtgatataaaaacggcagaaaccagcaacagacaatagccagcacaaggggaatgctggcatttagcataaaggccttcattccggactggtaagaccagcccggacctcctatcagaccatttccactgattgtagttgcggcaatagacagcgccaccggcatccagcccattgaccggcctgccacaaagtaatcttcctgtgtttcattccctctgcccagcctgactcccatataaagcaggccgcccagataaatcacaataattcccagatcgataattgacatgtttctcctccacacctcatactgtctctgctatagcaggcctgccatacatggcatcccggccggcgacatgcttcttgggcgctggctattgtgcggcctgccctgtaagctgttttgctgctttttcctttttatccattgttacaacaatggctccgaaggcaaccgctaatacagcaatcacgcctcccgcaagccgatatacattcgcgacgccaatcgcatcaacaagcgtaccgccaacaacacctgcaaccgtatttccgactcctgcatacatggcaaccgcaaaggtctgcgcagtactggaaagctccttcttcgtaatacgtgcgataaagtatacggatgccggcaggaacagtccgtaagataatccttgcagcgcagtcatccagattaactgcgtcggtgttgtggcaaaggatggaagcaggactctcagtatgaaaaagcacattgagataaacagcagatgggagtccttcattttcctcagaataatccctgcgagaaataatgccggcacctcactcagtcccagtacggaccatgcataccccagctgttcagtagtacctcccacctgcgtcatcagagtcgtcaggaaaccgtgcgccgaacggaacgctacatatagtaaagtcgccacaatgacaaatgccacgtatccataatttgttgctaacagctttaagtctgtaaactttactttttccttttcaatagaattgtttgtatccttaggtccaaggcagcccaggactgcaattaccatcatcgcaatgaatagtataaacatccactggaacccgtttttatcgaaaaaaccgcccacaatcgccgatgtggccgcatatcctaaggaggcaatgccacgtgtaataccgtaatttgtggttgggttaatctgcgcatccagtacagtccagttgtcaatcagaggatacaccgcctgaatgacaaatgagattgcggtggagaaaaacaaaatcgccatataactgcttcccgtaaaataaaacagtgccgccagcaccgatccgccaagcagggtacatatcattacttttttaatggacccgattctatcacagatataaccgaatacaggctgcccgataatactcgccagtgagttggccgatataataacccccagctgtgtgttagagcatcccagacttaatatataaggacttaagtaggcaaacaggatacagaatcccgcccagtatgccgtctggattattgtaaagctaatattctcttttgtaaaaaatttctttaaactcatccttctcttctcctttatccgcgctcattctttatggttcaaaactaaactgcagcgtatacttcattgtttcttcatttaatttatatatatctttcagttctggcccgcagctctgcgatccaatcccactcattttataatcaaggcacaaaaccgaagcggacgattcctgcaattcatgattatgctttttcatcgtcagctcttcctgagtaaagggaagaatctggaatgagaaagtgtcctctgatgataccgatattgtctggccggctgcattttttacagctgcctcgtaagtatgtagatgacttccgttttcctgcggccttatgtgctcctccatcatccctctgaccgtcgcctgatagcgtccgaatctggatgcctggtgcttgtccacgtaggcatcttccggtccgtatcccatgtatgaaacattgtcaaatttctccggaagaaacatacgtatcccaaaccttggaagatacggcatctccggatttttcgttccctcgatatccgtcactattgttccatccgcgaagatacgccagtaagattccacccccacgcatgtttggatatgcgaagctgccagttcaagagaagaatggattagaatgctttccacttcttgtgatacctccgtctgtctgacacaagcttgtatcctgtcgtatcctgctttgatccattccagctttgccaggcggtcattgtctgtcggggctctccagatattatactgtatcggcacatttgtgtacatacagccatgacagatgatcctgtcaggagcacctttatacttatcaaaacggtattcaaatgcttcgccggataccaggatatatctctcctcttctctcacctgtattttcccttttacaggatttgcaggcgccgttttatagtcttccttcaggaaaaattgatcaaatcccaaaactgcatcttttcctgcagcctctttcccactgaccgcccggtattccaaagtcagtgtccagacgccttgtcccagcggcggtatggtgagctgatactgtttctttttatgcgccggatggcaggaggggtacagattattctgatcgattatcctgccgttgcatgccacctcgtaatgaatgtaaagcctttcttccagacttgtgaagtccattttattctccagctctaccacaccatttacctgatccgtcagtacagcacgtaccggacggtgcacatttttaaattccttaagcccattatggggagttctgtccggaaacaccagtccatccacacaaaagttatcgtcgtgcagttcttcgccaaagtccccgccatagctgtagttatccctgccgtttgccgttttccccatatatacggcatggtcgcaccattcccagacgaagcctcccagtattctgggatttgcctcaaataccttttgataatcttccaggtcacccgggccgtttcccatcgcatgtgcatattcaatcagcatatatggtttgttccattccggttttttcaggtattcttctatcccctcaacggaatcatacattcttgtatataagtccagcatggatacatcattgctgtgtccaccggtttcccatatgctgccttcatactgcagcaggcgtgatggatcaaatgtcttgacccagcgcgctgccacctccatgcttggtccataaccggcttcattgcccaaagaccagatgatgacacaagttctgtttttgtcacggatgacgcacctttgtactctgtccatgacggccgctgaaaacaccggattctgtacaatatcgccatacgtcccgtcacaggatcctccgtatttttcagctgccccgtgtgactccaggtctgcttcatccagaacataaaacccgtattcatcacaaagttccataaaccacggcgcattagggtaatggctggttcggatagcattcacattgtgctgcttcatgaggtgcaggtcccttactgcctgttcccggtctatggccgcccccgtcaccggatcagaatcatgccggttcacccctcggatttttataggtacctggtttaggaggactacagatttttcaatttcaatctgccggaaaccgattctctgtataatggtctcctcatcggaaaccaatttcagcgtataaagttttggctgctccgcattccagagcaccggatttttaactgtaaactgcagccggtcgcccttgccctcaatttcagcaagcgtttccccctcaggtgtttccaatatccccctgagatgagccggcatcatctcatttaggtattccagttctacatggagttccccgctctttaaatcttctgttaagaatgtacggattgttaagtcccgtatatgctgagccgggcgctctaaaagatagacatccctgaatattcctgacatcctaaatttgtcctggtcttccagatagcttccgtcgcaccatttaagaaccaataccgccagcctattttcccctgcacagaccaaatcggtaatatcaaattcgctggttgagtgtgccacctggctatatcctgcgaaattcccattgacccatacataaaaacaggaatcaaccccctcaaaattcagatactgcctgtttttaagcgcctcttccgacaggctgaaaacatggacatatgctcccgacggattttccttcgggacaaaaggcggacggtagggaaacggataatagttgcaaacatattggtgggtatcgtatccgtaattctgccagcagccaggtaccggtatttcgtcccagctttgtgactggtaatccggcgcatagaacccctccggtatttctgccggatttgatgcataatagaacttccagcacccatttaaacttagcctggatgttgtgccatcagccttgttcggaatatagtatgcccggttttccatggtgcccatatgtagtatctccggattctcatggtaattttctaatcgcatgctcttttctcctttatttttctatgtttattatgcagtatattttcacagggttctatagagaatatctgcttatatatggacaaaatcacactattcctttaaaggatatcatgtggtacaataaataaaaatctttttacagaaaggatgtgtctgctataatcagcataactggttattaccgcagtaagcttgacgaggtcgaagatcataccgttccgctgcttgtaaacagcgcgggccactaccggcttgtaaagttaaactacctggaaaccacacgtctgaatggacgccgggattatcagattctatatatgaaaaaaggtaccgggcactttctgcttcacgggaaatatcagacggtaaccgcaggcagcattatcatctattatccaaatgaacctcaattttactattaccgcctggaagaacagcccgaagtttactggattcacttcaccggatatgaatgtgaagagctcttaaagcggtaccacatgtggggaagttctatactttacattggagtggatacaacactggtgtcgttttttaataatgccatacaggaactgcagctgcggcagcaggacttcctggagatgagcattctgatcttaaagcagctatgccttcttctgaaccgtacaagagaagagcagaaaaaccattattataaccgacagaaggatatttctgcttctgttttatatatccatgaaaattataaagcccccatcgttatccgggagcttgctgaaaaatatcatatgacttataattggttcatccgatgtttcaaagactttaccggttcttctcctcagtcctacctcacggatatccggatagaaaaggcaaaggacttattaagccacagatctttccagatcggggaaatagcggaactggtgggatactctgacccactgtatttcagcaggatttttaaaaagaaaacgggctgttcgccgaaagaatataaaaagagtgtctgttcccattaatttatacgacatgaagccaggaataccattatttaatgatgtatccaaaagtaaagttttaagttattgatgaatctgtcaagctgaaattctcccgcagatacaccgcagaactttttgatttttttacgaaacagctcataagaaatgtgtaaggaaagagggtaatggttaaaatcagatattaacccttacccccctgtttcaggctgcctattcctagaatacctatcctgtcagttatcttatccagttcatttattaatctaccgtgtcatcccgcagagcatcagacagattataattaagagcccttttcccgccaacataataagccagagcgacaaaccccaaaattaccagacaaaaaattacaattggaattatgggcgctacaacgataaattccattggatttaaatgactggccttaatcatgaatgccatggaagccacagtaagaggtaatgtaatcagaagcggtctgcctgcaatgaccagggcttcgatacaaaacatctttcgaatgcctcccgttgtcatgcccacagacatatactgtgctaattcccgttttctctggcgcagaaaccccagtgtgttggagaatacatttgcgattccgatcactgcaaggatggcacagaacccgcccagaatcagttgatatccgaaaatgatttcatcatttgtgattttctcctgtatgcggttttctatttctgttttatagtttggagcaagaagatgcagaacctctttttctatcttatccagagctttcagcgaagcgttttctccggccaaaattctgacgtaagtatctgattctgcgcctccgatctgtccagacacttttacccaaagtgaaagaggcataaactgcaccagcgcgtagtcttcatattcttcccttaaggctggcatttcctgcgtatatgctgtcactggaacttctgtcttctcttcttccgattcagcatcctgcaaaaacacggactcacgtttttcccctacaaagggtacatatttgggatatctgaaattgctgtgcagactgtcccagattctgttcaatatgatcgtaccgtcaagcctgggtgcgactcctatttgtctgcaatattccgtaaatgcggcatcatccagtatcacaactggcgccttcaccagccacgtgtccccctcttttgtaacggatgtccctgcaacagcctccggccctccaagcgaggccagttcttcactaagccagtcttgcggaacatggctgactgctgctgccttttggtataccgcaagatcccggactccttccagttccctaagctctcctgtctgcccgaatttctctatacctgtatcttttacagtcgccataacatcccacacatcctggtatctttcaaaataagtatacctggtgcttatacctgaaagcgtaaagaaacacaagatcagcgtgaatcccaaaaaagaaagcgtcagtgagagtgtagaggtacgcagagctttttttctggcttttaatgcatttcccgcaagctccccctctaacccaaaaagtaatgtcagtattcttgactgtcttttcttctttaagcacagttccccggtattgcgaatcgcttccagcggcgtcattctgctaagtttcctggccggaagccatgcagaaaacaggacagtaactatagaggacgccaaggtcaatgcaagtaccagcggatgataccgaaaacttaattcgtacctccccggaatgttttccgccaggacgttcattgcctggttcactccaaaacttaaggctataccgagcaggatgccaagtattacaggaattgtacaaagtacggccgcttcttgcatcagacacgtccggatctgtccgggcgtcgcccccacactggaaaaaatgccaaactgatgaattctcgcattcatggtcaatgcaaaagaattacgtataatcagtatgagagacagtgaaaccagtaccaatactgccagataaaacgtcagcaaaagcggcggctcatcatcatttggatcatgtatcagatacctggataataacaaaagatggtaagaagctgcatcttctttcagccccagtttttctacaagcagaggcatatcctcaaaaacttttctgggattctgaaaccatacgtccactattgttccattttctcccgacaactcctcattaatttccgcctttttaatattaccaaaattctgtatagcagacaaatcttccccacttatctgaccagtaatacggccctgccagtccccctcatccaacgtaatcttttcgacttcatatacccagaagttataaaacagactgcacagaaatgacaggaacagtgctgcaataaatgccgccaccttgattgatataccggaggctctgttgttctttatataacctgatgaataatccctccacatcctgatcacctctgtctttcgtcgccgatgatccggccgtcttcgatcgttataatgcggtctgcttccagcgcaatcttctcatcgtgggtaatcagcagaacggtctgctttaggttccggttcgataacttcagcatgtcaaggatctccgccccgttcttctggtccagattgccggtaggttcatcggccagcagcagcgccggacggtaaatcagggatctggctatcgccgcgcgctgctgctgccctcctgacagctggctgggcagagcctccagtttatcggatatgcccagcgagtttacgatagactcaaaatattcacgatttggttcctttttgtccagcataagcggcatcaatatgtttttcctgatggtgagcgttggaatcaaattgtaaaactgatacaccagccctaccttcctgcggcggaatatggcggactgggtcggattcatagccgatatgtcaacaccatctacccatacctttccctccgacggcttgtccacgcttcccaggatgtgcagcaatgtagatttcccggaacctgaggcccctacaatcgccacgaattcccccttatttaccgagatatgaacccggtctaaagcgaccacccggttctctcctgagccgtatattttactgacgctttcacatctcaaaatctccatgcgatcctctcctctcctgtaaaaatgaatgtagtccgtacctgttcaacaggtgtgtatcatcattataacaggttaaagtgactgctcagtgactgtaaaacctgatttcaaaacagcccccgccgccaggaatattcttcgccctgattgtaccgttctggagttcaatgatttctttcgcaagggacagaccgatgccgatcccgttcttcccggcattccggccacggtaaaagcgttcaaaaaggcggggtatatcttctccggcgaagccttcaccttcgtcccggattatgatcgtcttatagagcggattcttatcataagagcaatgtacggtaccgccggccggagtatgctccacgcaatttttgagcaggttcatgagagtctccattgtccagccgaggtctgcggtaatctctatttggcccccctccggaatgtcaatgctgacatccgcatcggttaatacttcctgtaaattatcggcagcaagagtcagtacagtatagacatccacggcctcctgtttcaaaggaagcgtccctgcgtccagccgggataatagaagcagcgcctcctccaggtagaccagacggttcagctgcttctgtatctgctcaggataatctccggacggatgggacctcatcatctgtgtcgtaagtgagatagcagtgacgggcgtttttaactgatgtgcaatattggaaagattctcagcaaatttgtttctcgcatccagcgccgcatctctcgtctggtagagcatcgtcacggttttatagatctcatcctgtaattgtgagaaatcgtcttctccggtttctgatatcaggcccggactgcccgtattcacattttccagataaaccgtcaacgcctttatacgcgccgcttccttttttctcctgcaacggaatgtaaaaagaaacagaatacttcctgctgaaaaaccaattgcagcaaacagatatggataccggtgggtggtcttaaaaaaatccgactgcctgtagccataactgagcagtacattttcctctttctgcattgccgttgtgtcactgtactcttttaaaacattcagcaccgtctgttccatgtccggctgctcctctgtcagctcccggaaaagatggcctataaactgaaaatgcatcctgttgttaaactctgccatgaacatggccgtgacggcggaggcaatcaaactgaccgccagtacgagcccgatcagtacgcctgcattttttcgtcctgtcatagggtatcctccatgcggtatccaaagcttcttacagttttcaagcaggagggctgatgcagtttctccctcagccgcttaattgtcaccgtaagagtgttattattcacaaagtttccattgcaatcccaaacctgctccagtaacttttctcttgggattgtctttcccttattcttcataaagagcataagcacctggtactccggctggctcaaactgatttcttcctccccacagaacactctcatcccgctttggtcaatggtaattccgtcgcaggtcagatattgacccgatacattcccggatctgcgcagcaatgcacagatgcgcgaatacaaaacttcaagttcaaagggcttcacgacataatcatctgcaccattttggaatccggatacgatgtcgctggaaccgccccggacggtcaaaaaaatcaccggaagctcctgccatctggagcggatccaccggcagaacctgtcaccatccccatccggcatattccagtccaccagggcaattgcgggcagattatccgtaatcgccttccttgcttctgctattgttgtgaaaacggatacgctgcaattgtgctgttccaaatatgctttcactgtctgcgcgatattttcatcgtcttcaatataataaacgtcgatcatctttccttcctttctcagaacttcaggttcgtgtcccatcctgtaagtaattgtagttccgctctgcatggagcacgaatgccgcttcctatatctgcagtaagtataataaattctgatgctcccgtaaagccaatcctattttcaaaaaatgcaggatatctaaaaaaggatatcctgcattttatttttgattatgtaaaaaacattgtaacagttcagacctgtctgaactgttacaaaagattctttatgctccaaagagccggtttgcttctttcatattttcaaccacggacactccaaaaggacaccgttcttcacagcttctgcatccaatacactcgtcccccctgtgcagcaggctgtgataatgtgacctgacagaaggaggcacctgatttggtgtaaggcgggcgatatccagatatttgttcaccgcagcaatatcaatttctaccggacatggatgacaatggccgcagtacacgcaattgcccttgaagtcatttttcatcgtcgcaatgacctgggaataatccttttctgcttcatccagatcaaaataactgaccgcactttgcacctcttctcttgtctgcgctccaaccatgacacttgcgaccgatggtcttgataatgcatagtggatgcactgaggtactgttaatggtttcgcaaaaggagaatgctcttccgagatcagctttccgccgcccagggatttcatgactgttattcctacctgatttgcgctgcagatccggtaaagttccgcccgcttcggatccaggcctcggtaaagcttgactcccatatcggtttctatatggtcgaatatatattcttctgacggcagcatatcaaaagcaggattgatgctgaacatcatcatatccggcacccctgtgctgatgaccttcgccgctgtgatcggattgtgggagctgaatccaatatgcctgatatctccctgctctttcaggcggagtacataatcgacgaaatccgtctcaaatacatccttgtaatctttttccgtgtcaataaaaaacatcatcccaaaatctatgtatccgaagatgccgagcatctcctcaaaatactttttcactgagggcagatcacggcttacatcatactgctcatgaatgtccgtggatccgatgtgcccctggatcataacctgatcccgccggtttccaagagcctttgcaatattttcgcggacctcccggcccggcataaacacatcaaagagattgattccattttcaattgcagcatcgatgacctctttgacctgctcatatgtctttccgtcaagatgctcacatccaagtcctatggcacttactttctttcctgttttccccagatcgttataaatcatatgcatttcctccatactgtacaccatctttcattgcggctgtataataagaatagcataatcatccaaattttactatcatatcctgctaatcagagccgattaattcttacctattcataaccgtatccccaaacaaatccatacgctgccccattacggagtccagccagttgacgctctttcctaccgattggatgcacccagcgaaaggaagggatatgcgcgcttggggggcttgcgcctatcccttcctttcgcgcccctttgcccccttcggccgctcaaagcttctctaactcccttacaggagccctgcaccttccgttctggcacagataatacatggcgccctcatcaggtataggatattcttttacatatggtattattttctctaattcagcctggttattgctggtcttgagaattaccgagcggttaaatacaggtactttcaataagtgttcttttaatgtctccggcactctgtcatccgatgcggtgcagataagttcctgtgacggataaaggatccgcaaaagagcctgcagtccaaagctgtgtccggaaggatatacttttgcagtaccggtaagaaaatttgcctgccgttccagagcttcctgccaaaatgaattgcaagtatactgcgccaactggctcaataatactgccgccgacgaattaccggaagggatcgcgccatcataagtttcttttggacgggttatcaaagtttccgcatccgatgcggtcagaaaatatccgccattctctttgtcttcaaacaattctgtcatttggcgagcaaagaattctgcatcttccaggtatattggttcataggttatacggtacagctccagaagcgccagtccatagaccgcatagtcatccagctgccctgctataacggcctccccctctctccatcggtgataaagtcttctgctgctgtctgtcatagattcctggataaaccggtacgtatcctcggcggcattttggaaacgggcatcatccagtaactgcgcggcttttgccattgcgatcatcatccaactgttccaggacagaattactttgtcgtccctgtgcagtgtcgtgcggtttttccggtaatcataaagttttttcagccgtatgtcatctgcaggccacgcacttcccttctgcccgatcagatttgggatactgcttccttcaaaattcccgctggcagtaatgtcatagatgcggcagaattcctctccgtcctcactgcctaaaacttccagaacctcatccggagtgaaaaagtaatattttccttcgatcccctcactgtctgcatcctgcccgcagtaaaactgcccttccggtccggtcagctcctttaatacataatccagagttcttccggcagtatcaccgtaatcccttttcttcgttatatggaaggcatccagatatgcaatcgcaaggagggcattgtcatagagcattttttcaaaatgaggcaccagccatttttcatctgtagaataccttgaaaaccctccgccaatctggtcattcataccgccgcacgccattgctttcagtgtgtgttctgccatttccatagtcattctatcgttctctaaactgccataatgcaaaaggaagagcaggttatggggagccggaaatttaggcgcattaccaaagccgccccacagtctgtcaaactgctgtctatataggtctaccgctttttttagaatccttttgtccggagcgctcccttcctcgtggtctgaaattgcgataaaatctgtgatctgctgcccggtctccaaaagccgctcccggtcttctctccagagccggctgattttctgcagcagttcaatgagcccgggatgcccgtagcgcggatattttgggaaataagttcccagaaagaacggcttttggtcaggcgccagaatcgccgtaagaggccatccccccgctccagttactgcctggcaggccgccatatataccgaatctatgtcgggacgctcttccctgtcaactttgatgcagacataatgattgtttaacaattcagcaacctgatcgtcttcaaaagattcatgtgccataacatggcaccagtggcaagtagaatatccaatgcttaaaaaaacaggacgatcctctgcttttgctttttcaaacgcttctttgccccagggataccagttcaccggattttcggcatgctgtaatagatatggggatttttcgttttttaaatgattcatatatatttgccctcccatctgcggttaatatgcccctttgaggcgtaccttattccgcagttgactgcgaattgaagctctatttcttcacgaacagtaaatacaacacaagcttccgaattactagagtgttcgaggcagagcatagaggatctggtaaagcgggattagctgcatccagtaaaagtggatgttaagagcaagttatttctgaaaagtgagatgcagcagtgtctttggatgtagtggatagtaactaaaaaacctaaaggccgcatttgtttatatccatgtggtctttaggtttttaaatcagatcattaaactaaactcgtttataatcctattcaatgcttatcaagtcatcaaatcatacttccatttaaattctacaattctccatgaaacatttctttatcaaactccggattaaagtagtagaaattcttactgtctaactgctcttttgtcttttccagtgcttctccgaatctctggaaatgaacgatctccctgcttctcaggaacttaagcggttccctgatctctgcatccgggatcatccttagcaggttgtcataaaccgtacgcgccttctgttccgcagcaaggtcttccgttaagtcagcaatggcatcccctttggactggaattcaagcgccgtaaaaggtactgcagatgcagcctgcggccatagtgcggtagtgtggtcaatatagtaagcatcaaatcctgccgtttttgcttcttcaattgtcaggttctttgtaagctggtacaccatggagcagataatctccatatgagcaagctcctccgtaccgatatctgtcaagaggccgccgactgacttcacaggcatggtgtatctctgtgcaagataacgcatggacgcggaaagttcgccgtccggcccgccatactggctgataatcatctgtgcagttttggggcaggtttttgtaattttaaccggaaattgtaatctcttctcataataccacatttatacacacgctccttcccacggcatcggtcccttttgccagcagaatctgtcatcatggctgccgcagtctgcgatctggcagcgcgtcagcggattaaatgcggatgcatattccttcaggagcatttcccgttcctttagtttttcttgatatagttcttttgcttcctcctgctcttcgtgagtgtccaaataaagcgtcaggtcatctaatacaaagctgacctgggcaatctttctcatcatgtcctctcttttgatctgctcatctgacttcttttcttccggcttttcggaatcagaagtatggtgatccatcacgatacttgccgcaaaaaacggtttgttcaaatctttaaaaatggtaccaatatccaatgcatctttgtcatcatataattctccccattgctgcatagggatggttgcaattgcaagctgtgtttctgacataattatctcctttcttgtaaatactagtgttgcatatttagtatctgcaaaaatcagagcactatattgtcaaaaattgcaataaggactcgaaacgccttattgtgttatcttccaaatgttactaagcaattgaaagatcattcagttatccatttttacaaaagcagtttttatcatggtcattcaccacacccacggcctgtaagtacgaatatatggttacagaacccacgtaccgcatgcctctattcttcaaatcctttgatatacggtctgatagttctgtctttacaggaattgtatctgcctgatttatgatgatcttgccatccgtaaatccccacagatatctggaaaaagatccgtattccttctgtatgtccataaaaattgctgcattttgaaccgccgctgttatctttccccggttccttataatctgtgggttctgcatcaggtcctccactttttctgttccataagctgcaatcttttttacgtcaaagccatcaaaagccaccctgaaaaattcccttttctttaaaatggtgatccatgaaagccctgcctgaaatgtttccaataaaaacatctcgtagagcttctcatcgtcgtacaccggtatgccccattctttatcatggtattctatataaacaggtgaagataaatccacccagaagcagcgcttcttctccatattgtattcctccttctccgccgcattattcttgttcagcccactttgcaatacggcacatcttcaaaaccagtttcctgtcaaaaatatgaaccggtatgtccgcatcaatcggataaataatcgggcaggcttcgtcttcaaaaaagtacaccagcaccgctttctgattcggatctaccagccagtattcccgaactccggcgtcttcaatctgtgcatacgtataacctttctctttcttcttctgcttcatctcctgaatggtcataaccattcctcctccgcagcatccgtttatggttatattttacaacatttacggggaattgcaaaccgaatcttatgcaatatcggttaaaattcggtgtgcggataatctttaaaaaatatgccgcccttctcctttttagcattcgtggaatacattgctcccagcacaaacaatactgagtttatcataactctgtccccctggttatcggcaaaaaaaccaaaatgatactgttaaatctgcgcatcaggcattataataaagccagtagatcgtaaaataagtaacctgctgtttatagcctgtgaatgattcttgagaagaaaggaaaatgcggacaatgaattttttaacaaacgaaaaaacaaaccacaattatgcaacaaataacagcaaaaaaatccggaccgctgtggtaggctgcggtgctatcagcgatatttacctgaccaatatgattcatcggttcccgaacctggaggtcacagcctgcacgtcaagacatttggagtcagctcaaaaaaaggcggctcagtatggaattcgggcctgcagctatgatgagatactacaggatgtaacaattgatatggtagtcgtgctgacgcctgcgccgacccactatgaattaatccggcaggctctgcttaacggaaagcatgtgtatacggaaaaaacaatgaccgttggcctggaggaggctaaggaactgatacaattatcgaaagagaaaggcctgtatctcggttctgcgccggatacattcctcggagccgcactgcagaatgccaggcgggcaattgatgaaggtgtaatcggcgaggtaacttcctttcaaatccatgccaaccgcaatatcgatatcatagcgagtttcgcaacgtttctgtgtatgccgggcggtggaatctgctatgattacggggtttattatctgaccgctctggtgagccttttaggtccggttaagcgggtatctgcgattgtacggaacaagaatgaaaaaagaaagaatacgagtccgggaacaccgggctatgggcgggagtatgaataccgcaacgaaagccaggctgctgcagctatggagttaaagaatggtgtatttggtacatttgtattgaacggcgacagcattttgcaggatcaggcggaatttatgatatatggaacagagggtattctaaagctttctgatccgaatcaatttggcggggaagtgattcttatggccagtgacagcaaacagtgggaggcgacaacgaaaaaagccgttcattatacggatgcattttcggaaaatagcagaggaatcggtccggcagagatggcatcagcaatcattgaggggcggccaaaccgggctaataaggagatggcatatcatgtgcttgatgtcatcagccagatgatagcgagcagcgagagcggccggtttgaggaggttctgtcggaatgcgaacggccagccgttttggaagataggatgttttagaaaacggacactaaaatacataaacgctcaaaaagccaggaagctgataacctttctggcttttttcgtataaacctagttatagcggatagatttccagagcttccagccgttttgctttcgccgcagggatcttcccctttctcagggctgttctttgcacggaaatccaatttcccatgctccgcccgtccggtgctttgaggtctcttcgcaatggaagccggtcattttctctcttatagtcactaacccactgatacatggcatcccatttttcggcccggacattgtccagtttccatatcatagaaagccggtccagagcctgaatctgtgccatgttaagaggctttcgctctccattgccattatagcgttcccgctgaacgaaaacccataatccaagccgttcccctctctttgtcttataggtcaaaggaaccagcaggttcccgttttgctgaaaatactctgcagccagggcataccagtcattccagtctcttctttcataacagctccagatcataccgtaccggtctaaatccctgatttgtttttccgtcagttttccggatttccgctttttacgctgttctctgatccagtttccgagcctgtatccatgggccatataatctttatggacctccaggtttccatattcattgtaatattctcctgcaataaaaatccattcatcccacgccaatctgttctccagcttccataccattccgatcttctccaaagcggcctgctcatccaaatcaaccggatttgcaagaacaccgttatatctggcgcgctgccgctcgatccaacgccccagcctgtaaccgtctgctgttatgtaattgtaagggaccagcagatcaccatattcttcaaaataattttttgcacacaaataccattcatcccaggtctgcctgctatatattctagacattatttcacgctccctcagctgcgtaaaggaatcacaatagccggaatttatggatccattcggttatcttgtgatccttttttctcctcccggagacataatgtctattatgtcgtcaaacctgtcgttatcctataattgaatgctgaggtctatctctaagcttaaaaaacagtacaaaaacaaagccgtatttgaatgaaaatcttaacggctttattttcatatctttttaattaaacaggattttacatgcttggagattttcttgtttttgctacttcaagttgagcaaaaattccattcatgctataatgagcaaagtaaaaatctatgtagaatatattcctggacgacataatagacattatgtcatcaggcacatctgtacacgttccagacaattcatatgctgccttcccgtgctaatcgtatagatacgcgttgtgtttatgctgctgtgcccaagcagatctgcaagccgcacgacatccttctccatcgaataaaatgtcctggcaaataagtggcggagattatgcggaaataccttatgttcagatatcccggcccttgtgcacaaggctttcatgtctctccaaatgtttttacgattgaggggttttccatttctgcttacgaatactgttccattttttagacctgtttcttttatatactttaataatattttctgaagcgctgccggaatgaatatggcccgtgtcttgtttttacagtggacaatagctttaccggccctgacagcctctactgtgatatactccagttcacttaccctgatgcctgtaccgcagatcgtacggatgataaatgccatccttgtattgccggcagctttcaccaaacgctggtattcctgcctgctcagttctttatcttctgaggcaaagatctgtttctggattttcaataattttacacaatagtcctgcccgcctgtatagcgcagaaaacaattaagtgataccagcatagaattcacactggcgggagcgtatttttcagacagatattctttgtaggcaattgtccgttctttgctgacgcacccgttctttaaaaaccctataaaacaacggatatctctcatgtatttttcaatagtggctttgcttttttcctcttccgttaaatatttttcatacgaaataagatgatcctgattcactttgtacatgcttttcctcctgagaacaatttttttgataatatcattcccattatacggagaagtattatgataaagaatgtcagtacactttcatccgaaaagtcacatacaccgctatgctcttatacttcatgtattattttcctacaattatgattaaagcggcagatcccgcttactaaaccgaacaatcccaatcccgataagcaccagcccggctgcatacaaaatgatgcatgtcatccatgcttcaccgtcacctgcacccaatccatcaacattaaataatgtcagcggagttgcatacttcaggttttcaaatttatcccctactctggaaagcatctgtaccaatagggaatatactaatactgctgtactgattgacgaggaatatttggattcgttacagaaacaggatgcgcagaaccctacaccgcctaaaaatatcagcagccccagcaatcctatatttactctcagaaatgctttgatttccatttctccaggaaacattccctcactgaaagcaagtatcagcaccgtcgcaaatcctaccataatgaccaggcacagaatcatgaagaccgcctgtgtcagcataatcctccagcgttttaccggagcagccagcagatatgccattgatccattgtctacatattttgcagacagcctattagtcagaataataataaacactccgggaaaaccgataaaaagccagccatacaaatagcttgaaacaaactgcaacagggtcgttccgggactatccatgccgaaggccgagaagatgcccggcatactttctgccatcagctttaaactgtcacccattttcgggtcaaacatgattgtaatcatgcttccatacacactgagtactgccagaaaaataacaagcaatagccagtttgattttatttcctttttaaacaacgcggcattcattatctgtccgccccctctccgtaaaagtgcataaagaactcttccaggctctgcgtccgcacatctaaatccactattgtatattcgcctgccttttttacaaaagaatccagatttctgccgactctggccgtcacagtcctgcctcctgcctgataggctgccctcggaaagtctgtggcgaatgcctctgccatggctgaatccttgaaggtaacctcaatattcttctgtcgtccctctttaagcttttcgatttcctcaacggcaactaattttccggcacggataatagcagtacggtcgcatgtacgttccacttcttcaaacatatgggaagacatcagtatcgtctttccctgctttttctcagaaagaaccagctccacaaaacggttctgcatcaatgggtccagacctgaagtaggttcatccagaatcagaatgtccgaattcgtatccataaaggcgcacacgattcctatcttctgcttcatgccttttgacatcttcttgagctttccggacgcattcagctcgaacatctgtatcaactcctgcgcgcgtccgaggccattcatattcttcatctttgctacgaattttataaactccattccattcatggagtcaataaaggcaatctcgccgggcagatacccaagtgactgctgtatcttatccgcctctttgaaacagtccatcccccggatcgaaaggctgccgctgtccggtttaatgaatcccattaactgacggatagttgttgtcttaccagccccattaggccccaaaaacccaagaacttctccttgtttcacgccgaagcttacgtcaaatacgccccgtcccctgccataatcttttgtgatatggctgatctcaattacgctcattctgatattcctccttatatataagccttctcatcatgtctatccagcccctgaattcccattcatgacgcgctcctctcctggttcgctgcaataaattgtccggaccggtttgactttctcagtcaaaccttaatatcagaataccggattgactattttttacaacccctctgcagcatttttatttgattttaatctcttttaattcttcctggccacccttcctaaaactgatactcctccttatataccagcttcttcatcatatccatccaatcattaaattcatttaacagttcgttaatatctatggctttcccagccatttgtttatcgtggatataaccgtcccccatccacctgagcattttataaaccttaaaaggctccacgctgtccttaaatttataagtgtctatatgaccaaaatacatctggtacattacttcttcctgcatggtattgaaagattttaatgcatccgacacaatctcattctccgagtaaaaagcccgcatcgcaaactccagaatatacggatgcttctcaagtataactgcttttccagtgcccgcatagcgcagcagttcaaaaaaatcggtcagttccagaaaagtcgtgtccgcaatctgctccttcataatatcaatcagacaatgatagacatacagatacagttccttcttgttatgaaaataataaaaaagcagccccttcgaaatcccggccttaactgcaatcaaatccgtagatgcccttttatactcattcttcccaaacacttccatggctgcgttaataactcgctgctgcttctcctcggaaagtgccaaaaacttctcattcatactgtccctcctccgctcttcagtcattttaactaatcaaaattactttgactaaaccggtcagtcctttcttacagaatacatgattgactatttttttcaacccccaaaaccatacaaatgtatactgtcccccttccggcgtcaaagagtatgcttattctcaaaaaaaaccacaccggtgtctttcgatccgatgtggttttatccagtgaaactttactcctactcatatgaatacatattttgccagtctctccatagcctcttccaccagaacctttggaagtgccagattgacgcggatagaatatttcccatagaacggccttccatcctgccataagacgccgacttcaactcccgcccttaaaagatcatccagtgattgttcatgctttttgcaccacgcttcacaatccaaaaacagcatgtaagttccctctggttttgccaaggataccccttcaaaatgattggtaataaactcgtatgcatagtcggcgttttcccccagcactgtcctgagttcatccacccactctctgccctcctctttgtaagcgccgatcagagcatgcatggacagaacgttgcaggaattatagtgggaagctgatgcatattttgcaatgcggtcgcgcaggtacggcgcataaatcacatgatatgaaccaatcagtccggccaggttaaatgtcttggatggcgcatagacggcaatagtccgctccctggcatcctcagatacagactgcagcgggatatgagtgtgccccggcagtgtcaggtctgcccatatttcatccgatatcacaacacagtcatatttttgaaataaaaccatggcctgttcaagctcttccctatcccagactctgcccgtaggattatgcggggaacagaagattacgcagtgaatgtggttatcacgaagctttctttccatgtcttccagatccatgcgccatgcgccgccgttgctgcgcactaattcactcagaacgagttttcgtcctatactttccacggtttttgtaaatccaatgtaggcaggggcatgcataagcactgtttctcccggagcggtaaacgcctggagcgcggatgatacacagcccagaaccccattttcatagcctatgtcctcccgcgtcatgcccgttaccccgaaacggtctttctgccagttaataatactgtcataatatacatccggcatatcaaaatatccgaaatgatgatgcttcagcctggcctccattgcttcaaggatcgtcggaagcgtagggaaattcatatctgcaacccacatcggaatccgtgtaaatcctttcttgacctccacgccctccattgggatagtgtccactgccagcgcatcgtgtcctgcccgttccatgattgttgtaaaatcatatttcataactttggtttatcctttcctcaatcgttttcctgattttattaaactgtttctattctataccgcatatttccgcccgtcaagacaccctgcccgtttccaaaagctgtatccctgccggtctgcagcagttcaggcaggtctgaactgttacaccgatctgtccggtcaggcatgataacctctactgcctattgcttttccttatttattcagatataatatgaactagtataatatgaactagccttatggacttattgaaatgttctgtattgccagctgtccttaagaagtaatgatcacgaaacgattttcatatattaaaggagataaaatcatggaactggaaagagatccggctgttaaagagccctccgctgtattatcggaagatattgccggcaaatataatgcttttctggaaaacatcggctccagcgcatgcagatttatatttgacaacgatctgactctgctgtatgcaaacaatagttttttcaaaagcacaggatatacaaaaaaagaatttctgtcacactttaccagtctacgactgtatcttaaaaaccatatcacggaattcaagagcattcagaacgctgctgctgatgcagtcaccaaaaaggaaactgtttttacagtggatttcacacttccgttaaaacaaaacggcggcatcaaatgccgcatgacagggaacctaacaggggtgagtgcctcaggcagccctgttttttctgccgtcctgacagatatcagcgacctggcagctcagagtgaggaaaaaggaaagtattttgaatggatgatggacagctatatgggtaatatttacatcagtgatatagagacatatgagcttctttatctgaatgcggtcgcagttgaaaccctaaagaccccaaaagaaaaagtaatcggacataaatgttacgaagtaatccagggaaggacttctccatgtcccttctgtacaaataataagctgcgaacagatgaattttatgaatgggaatttcataatccaattctggaacgtacttttatgattaaaaacaggcttattaactggaaaggacataaagcacgcattgagctttcccatgatatgtacagtgcagagtataagctggccaaaaaagaccaggaacgggaaacgcttctcagaacgataccgggaggtttcacccgcctggacgcaagggattttaacacggttctctggtacggggcagaatttttaaaaatcatcggatatacaaaagaacagtttgaaacagaacttcattcccagtgttcttacatacatcccggtgacagggaccggctgcacaccctcttgaaaaagatgcagcataccggcggaaacatgattacagaggcccgttttattacccgcagcggtcagacgaagacgcagactctgacactgtactacgcagacgctgaaagcagctgggacgggattccttccttttacagcgtatgtatcgatgtaacggaagaaagaagggaacaggaacgccagcgtaaagctctggaggatgcatatcagtctgccaaagtagccaattctgcgaagaccaacttcttatccactatgtcacacgacatacggactccgatgaatgctgtcatggggatggctgccattgcccaggccaacctcgacgagcgggataaggtccgtgactgtctgaataagatcaatgtatccagccgtcatctgctaaaccttatcaatgaagtgctggacatgtctaaaatcgagagcggaaatatcgatctgcagccggaagaggtgactctcccggatctgattcagaatgtttccgatatttgcaggcctctcattacagaaaaaaaactgaactttaagatcagtgtcagcgatgtccggcacgaaaagattactacagatggagaccggctgcagcaggttctcatgaacctcctctctaacgccataaagtacacgccggacgagggcactgtcagtctgcagattaaagaaatcccgtctgtgtcagataaaaaaggacaatttgaattcatcgtaacagacaatggcatcggaatgtcagaagatttcattctgttcatttttgagccgttttcccgggccgaagattcccgtatcagcaagatccagggaaccggccttggacttgctattacggaaaatattgtgcgcatgatgaatggatctatcgaagcagcaagccagataggaaaaggaagccagttcaccgttacgctgcagtttgatctgattgatgaagatatcccccgtgacagtgaactggaagggctgccagtccttgtcgtagatgacgatgaaatcgtatgcgaaagtgccgctgcgcttttaaatgagctgggcatgcggggctcctgggtgctctccggagcagaggccgtccgccgcacctcagatgcacaccgcagcggggatgacttttttgcagttatcctagactggaaaatgccggagatggatggattagaaaccttaaaagcgatccgaagcaatctgggggaagacgtacctgttatcattatctccgcctatgattattctgatatcgaagcagaatttttgagcgcaggcgcggatgcctttattacaaaaccgctgttcaaatccaaaatgctgcatgtcctgcagacatttttaaacagcggcaggctggaaacggctgcttcccaggcagagatcgttcatccggagcttgccggaaaacgtgtgctgctcgtggaggacaatgccttgaaccgtgaaattgccactgaactgctccagatgcaggaactattaatagacactgctgaaaacgggcggagagctcttgatatgttcgaggcctcggagcccggatactattctgcaatcctgatggatatccagatgcctgtcatgaacggttatgattccacaaaagcaattcgaggccttgcgcgggaagatgccaagaatattcctattcttgcactgaccgccaacgcttttacctctgatatcggaaaggcatacagcgccgggatggatgaccatattgcaaaacccattgacgtaaccctgttaatagaaactttgcagagatacctctgcctgtgattttatgtgcaaatcctaccgcggtatgatatgataaaaaaaagatcgtattatattcaggaaagggatgacacaatgtctaattataacagccaggaacaaacaatctaccgtaaccttgccggtaaaatacaactgggtttttacgatgatggtgcgcgcttcccatctgcaaaagaaatagccgaaatgtttcaggtgtcctactgcccggcccagagagctctcaagatgctggaggctgaaggacttattaagttgtgccgggggaaggctacaattgtactggcaaagccattccagaattatctggagagcgatatttttaagcggcgcagcaaatctctactggatcttgtcaaagccataaaactgctctctcccgccatatgttcccacggcgcaagtcatatggaaacggggggtatttttgaacagactcacagccaaagtctgccgtatcgaaacacgaatatgtggatacagtttgaacagtcgctttttgctctgggcagccatacagccctcagcctgtactacgatatcagcgcgtttgccggaagttcttttctggatatcctccggctggtttgcggagatcaaaaagctggtattcttatacatagcacggccgatgaatacctgcggtatattcaaaatgataaaaaatacggatctgccatcacaacacggcatcttgataagcttgcagaaactttcttttggattatagaaaactatctggaggatatgccgcccattcctgaagacctgaaccaggaactcttttactgggaaccgcaaaagggccgaacccgctactgtgatgtggtggcaattgatttgatctgtaaaatcaaccagggcatttacccggtgggcactttgctgccgcatatttctgttattgcggacacctatcatatttcagagatcacggccaggcgtacgattatgctgatgaataagcttggggtagtgaaaacactcaacggaatcgggacgcgggtaatttttgccggtgatgcttcgattccccaaaagctccaggatctgactttggatgacaatatgatcatcttcctggaagcgctgcagtttctggccattacgggagaggcggttatggcatacacttttccgtatatttcagaaccacttctggaagacattgtatatgcggcatcaatcccggggcatgaacgctccagagtcgctacggtgagcgccgtactgcaggccattgtccgcagctgtccactggcagcaatacgcgaaatttacagcaagctcacacacctgctgttaaagggcagtatcctacgcctcgagactaccggaaacgaatccattcccggatggcccgggaccgttgactctattttgaaaggctgccaaacgcctgatggcacagaactggccgccgcctgccggcagctgttcgtaaataattttgtctcaaccaaacagacactgctggatttgggaattcataaggctgaaaaagtaacaggattttagaacaataaacctaaggaatataagcgaggctgaaagatgattttgaaatcacttttcagccctttttatcctcttttattcacttattaataaaagctcctattcattccagggcggttcttcctccccggattcagagtttccggcaacggtaatacttccgggggccttcatcgtgcgtacattgattccatttacctcaatgtggtcatctaccgcgataaccaggcactgcctgccatcgatcactcttgtttccacaagatccatccgttccggattgactttgatgataacatccggtgtttcaatattgaactttcttgtctctgcaatatttgcagcaagcagggaagccttttctcctgccgtctcctcaaagttcttatcgaattcctccatcttctcgtttggcactccgctcttctcaaataacttttttacatcggtcttgtccagcgccagcggctccggctcttccttatgttcttcaatcatatcgtttaaagtttcatggatgctgcggacagtttcgtagtcgccgtcttcacccagcgtatcttcgatcagaagctggaatgtctctttctgggtgtctgcggacataggcatctgtgcccccagtacgcggtcaatcatctcttcctgcagatcttctgactttttcgtataatacagaacgccatggatatccatattacgatctgtaaatgctggaaacaaaaagcccttatccggcatgtccacaatccagtcacgaattctgtcctgaatccggttgtcctccgcattgtagcaaaggcctggctttgacaggcttacaggacaaatgctgcacaggagatattcgtatacattatcggatgcgtcaaacatctccatatcatcggatgatttgcctggaatatcatacattgcatggatcaggacaatataataattctcttcatatatgtaactgtcaataatcttatcatagaattcttctagcagcatatcatcttccagcttgctggccctgagcttcatcaaaaactcctgggtccctccgggcatctctgcatccagcggaaattccatgttcagcatattgcgtcccattgcccctgataatgtctttttgaaaatatcaaaatatttaaatgcttcctcctccggcagcgagagaaatgcatctctggactccatttttttattcttttcatggtctacataacatccacaaatgcgggtaattgcacagtttgcaggtgtaaactgttttctgatttcaagtacttcttttttattcatttatcttccctctttcttctattaactttgcatagccaatgtgttttggttctgaacagtaactctattttgttactattcacggcctatggaccgcgcatagcaacggcatctggctcattaaaagtcgccagacgcgaggagccagatgcccggccccatcactttattggctcggatgccgtgcagcgtggtgcacggccccgtgaacagtaactctattttacatcaaaacctcttttcagaaaagcattgatttctttttttatctgtgctagagtatgtttgttattactattcagaccgtgccatgcaactcactgaaagcgactctaagcggacagatgccggttctgccatagaacttaacaatcgcctgtttcctgccgccgggtaggaaccctgaagcattcgtatgtcataccattaggccctggaaggtatgaaacacggatgtttttttaatctttcttataaaatcaaggacatacagaaaatgcacgacatgattggattaattctacggaggtttatatgaaaacagattctatttttccgacttttatgaaatatgtctctgccaatattctgggaatgataggactttcctgttatattctggcggacaccttttttattgcccgcggagtcggggctgatgggctgactgctttgaatcttgcgataccagcctacagcttcctcaacggactggggctgatgatcggaatgggaggagccacccggtattcgatagccggaggcagcggtgatacgcattcacataaaaccgtgttcactcaggcccttttatttgtaacggtactggcatccctgttctttttggcaggcctgctgtttccctatcagatcgcagcccttctgggtgcagatgagtccattctgccgctcacagggatatatctgcgcattcttctcatgtttgcgcccatgttcatgctgaacaatctgctgatctgttttgtacgcaatgacaaaaagccacagctgtccatggcagccatgctggtaggcagcctgtccaatattgtactggattatgtctttatctttccgctcgggctggggatggcaggcgctgcatttgccacaggagttgcccctgtcgtcagcatgctgatcctgtcccgccatttccggcggaaagaaaaccagttccatctctgccgcatcagacctagcttgaaacggatcagggatatatctgccctgggagtctctgccttaatcgtggaggtctcctcgggaattgtgatgattgtctttaactttctgattttaaaagacagcggaaatcttggggtggcggcttacggaatcctggccaacatagccctggtgttgatctcgatcttcaccgggatctcccagggtgttcaacccattttgagcagctgttttgggaaaaaagaaaccaaaaatgtcaggaacttactgcgctatgccctgactgcgtccatcctttttgcatgtatttcctatggggtcacctatttcttctccgatgggatcgtagagctgttcaataaagagcgcagccctgctctgcacgaaatcgctgtgaacggaatgcacatatactttacagccttcctattcgccggtgccaacatcatttcggcagcatacttcagcgctgtggataaaccaggccgtgccttccttatctcctgtctgcggggttttctctttgtcctcccactggcatttatcctgtctgcactgctggggcttaacggaatctggcttaccgtaccggcggctgaattcatgactaccgcggtggtgcttttgctattttggacaaagaagtgaggtctgcgcctgtatgaagcgggtgtctgcggggctggggaaatgatagttggaggttctgtgatacgccgattaatagaacatcgactatgctaaataacgggtaagtaatcttctatattccatttggattccataatagttttccagagcaggactgcagttttctgctacttcgtcgacgattttgtcaaagctttcttgtatgacggatataatcaccggatttagctttccgccctttgccatttcccgaataattgagagagttctttccttagaaaaggcttctttatagctgcgtgtccctagaagtgcactggctatatcagagacagcgacgatctcctcatctagcgtcatatcttttccagtgattccttttggataaccgctgccgtctactttttcatgatgccgcagagcaatccgggtcacgtcggagtcaacacttccgcccagtatacgctctgtgatatctacgtgtgtcctcatgatattcatcgcctgcgtgctgagctttccggggaattcgagtatctctaccggaatcccgatcttcccaagatcatggagcatggcgccatatcggatcctctccgttcgttccggggttatacccatatgccttgcaaccgaacaactgatactggtagttgtaatggtatgtgttaccgtgtgctggctgcggaaatcaattgcataaatcagcattcccaggtactgcctgcactccgtatcggtaagtttcatattcgataagatcccttttgtttcaatatcgcccttttgaagttttgcaaaaagagcatattcctggtctgcctttaaaaacaaatctattacatggtctgtaaattgtttgccgcgcttttcttccagaaaagctgccgccctggttctgacctcttccagggtgctcccttgtctgaaacttctgctgaaaatctccatcctgtcggccagattgatcatctgtgcggccccccggattcccggtgtcaggcgcggaagagccccagccgctgtatgatgaaacaacaccgcctcagcccaatcttttaaaggagaaaggtaacgtaaaaagacatatccatatatggaatgctcccagacatctcctgtctcaaattcaaccatcctgtcaatctcttccgtcttatatgcgcctatatcgtgcaataccgaaaggagacagatgtcctgcttttcctgtctgctgtaactgccttcggcgtccatcatatgtgatacgaggaaagccacccggactccgtgatccacaagtctggtgtccacctcattcaaagtacgctgaattaacccaacaatattgtcgctgtttattacagtatttacccccatcccaactccctgtcatccagtcagcatatctgtaaaaggccggtattgtgattttccccggatcctcaatacattccgctgcctgccgatccctttctatgtaataatacttttattttgcatgcatcctcaaaataagtcaagccgaatccatacattatctatacgttcccacacggcggcagttcatgcctgtatgaactgttactgcgcatgaaaatcgctttgcaggataaaatacaaagtatgtttaaggcgcatgaagcattatgccctttggacgggtttgcagcatggcagcaaaataagatatatttattactatcacattttatggaggtatctagatggacaatataagtgaaaaatttacgtttaaccccgaagaagctctggaggattttcaggcatatctgtatgaacgcgagaatgcaaaggcgacgatatcaaagtatataacagatatccggaccttttataaatatctggaaggaaattatgagattgataaaaaatgtattgtttcatataaggaatggctttatcccaaatacaaagctgcgagtatcaactcgatgctggtagcattgaaccagtttttggaattctggggattgggaagatggaaagtaaaaagactgaaagtacaaaagcagttatttatacctgaggcaaaagaaatgacaaaacaagattataagaatctaattgaagcagcaaaaagcagacataattcccagctggccatgagcatagaggcgctcgcggcaacaggtgcaagggttagtgaattggtgttttttactgtggaaagcataaaaaagggggctatcaccatttcgaataaaggaaagcacagaaccatactgatttcagatgccttgaaaaaaaagttactttactatgccgttaaaaatgggataactcagggatgtatatttgtcacaagaaatggaaagcccaaagacagaagtaatctatggcgggaaatgaaggcactcggcgtaatttcaaaagtcccggaacaaaaaatattcccacacaatctaaggcatctctttgcccgcgcctattataaacttacaaatgatatagccggtctcgcggatctcctgggccacagcaatctggatgtaacaaggatatatactgcaaacacagcggaaaattacagaaaactgattcaacggcttggacttgtaacagagcaataaaaaagacaccctggtgtttttaacaacataatattagttatgttgtagctctatgccttgttatcgtttatattgaataaagggggcccatattagaaactaaaacttgacatgactttttaaaactgttaaattattagatataaataattgttgctatgtatggctgatttacagacttccttgatttaacaacataactaatattaagttgttagtagttcattgagaagtcaaagaaaagagaggatgagataaaatttacaatttttgaagacaaatgctgcttccctgaatgatctatttcgttcaattccgaaagcagtgttagtttcatgtgccttaaaacactcatttcctatccaaatcggcccagccagccgatttcagggaatagccaaacaaactcaggtatataaaaatgatgccgccgataattcatatagatatctccgcagcctttaatccctcctaagaattaatggctgcggggaaaaacagatcaaagggagaatacataagatgagcaaaattaaatacccattgcataagctaaaatactgcaggaaatgtatgaatgaaacatttggtatgaatttacaaagaaaagacctatacgtctattcctaccccatgaaatgcagccgctgtggagaatccaaaaatataatctacaaagcccgatttccctataaccttatcctccgttccaaaataaaccacatgcccgacctggaagcaaaattcaacgattaaaaaccttctaacctaaataccttacaatccgctaaacacatacgccgcacaccgcagcttccttcccaagtgaaccgccataccggcctgatgcgccagccggggcggagccggatatgtggcgtacccggctccgcccattcatgaacagcccgggtacgccacatatccggctccgccccggcatccctccatccacatcgcctcatttactaagcgcatctatagctctcaattcctcgtctgaaaatgttctgttatgtatgatctctatattctccgtaatctgctccggcctggaagctccaatcaatacgcttgtaatatcattatcctttagtatccaagacaatgccatctgagccagagtctgtcccctttcaacagcaagcgcatttaatccctttatctgctcaagtcttgtctctgtcaggctgtctttctttaaaaaacgtggatccctggcgatccggctatccctgggaataccatgcagatacttatcggtcaaaagcccctgtgccaacgggctaaaacagatgattcccaaacccgctgcggaggcagcttcttttacgccatcttcctcgattgtccggtcaaagatggaatatctgcgctggttaataatcagcggacacttcagatccttcataatttccattgcctgaatcgtatgtttcctgtcgtaattagagattcctgcgtacaatgcttttccactgtgtaccgcctgcgcaagcgccatcatgctttcttccacaggggtatccggatccatgcggtgatggtagaagatatccacatattccagatccatacgcttcaggctctggtccaggctcgccagcaggtgttttttgcttccaaaattcccgtaaggtccttcccacatatcataaccggcctttgtactaatcaccaattcatctctgtataccccaaggtcttttgccagtatccggccaaaattttcttccgcactgcccggtaccggaccataattgttagcaaggtcaaaatgtgttatgccatggtcaaacgctgtccggcataaagccctcatattctcaaaatcacaattgcttccaaaattatgccataatccaagcgacacggccggaagctgaagcccgcttttcccactgtgcagataatgcatttccccgtatcgattttcagatgctttgtagtctgctcccatcatatacctcctgattcttatttacatacggctgtccacaactttagatgcatctgccgaaaggcattccttttctcatacccgcaggcgggtctgcatccagccggtcatatatctgttttttattgtatcataattcatgctgcctgtttaaatcactttctatctccggatattgttcatccaatgtataaaacgaaatcaaaatgatgactgctgccgacagcagaaagggaagtccggcaaaattcacgcgaattgcaaacagcgtctctgcgcccccggcatttcctgcctgatagccgcccagttttaaaacaaaagcacatatgtagccggaacaggcgatccccagcttctgtaccagagctatcatagaggtaagaaagccctgaggcctcactcccgtcttccactgagagtagtctattacctgcgaaagcataacaaaaaccatccctgtggccatggcccagccaatgctggctgttatatgaaataagattactgccactacatttttacctgctgcccaggttcccgccatggacacacaccataatatatttccgcttctcacgcaaaaccgcattccccgccttcttgcgatggacggcagtacaaaggcaacggcaaccgaggccaagggcataatcgatagaaaaagggagcttaacgtttcctgccctagataatatttagtataatacagggttccctgattccttatcatcatataggtaaggctcaagaactgtacgccgcagagtaccagccagtgcctgttatcctttgcagccttcagggatcggaggattccgcccttttcctgtccctttccgggcttcacccgctccactacattcgcagcgcacacgagggaactgcacaggaaaataataccaaacaggactgccgccagcataaagccctgtcttttgctgctccccagttcgtttacaagccacagtgtacaggcggttacaaagataccgccgcagttcgccccaacatttttaaaaagattaaatacgatccgatcttcctgtctgccgctcagcacggtcagcatcgttgaataaggaacattgataaatgcatacaacaggctgaacaggacataaatcattgccgcatagaaaactttaccctgttctgaaaaagaagccggtgaataaaataatgcacacatcagcagacataccggaagtatccctgctgcaataaagggcctgcactttccataacaggtatccgtacggtctacgataaatcccataacagggctgaatactgcatctaccgtccttccagccagcaggatcacaccgatggctcccagatccagctttgctgcgtctgtataaaaaaacattagatatgttgatacaaatgtaaaaataccatttcccgaaaaatcgcccagcccaaaactaatcttttccaacttcgacgggctgctcattttctgctcgctcaagtctgtcttcatcggttttttggtatctgcggtacggtattgtcaccgttaccctggtacccactccttcctcactgacaatctgaagaccgtatccgtccccatatatttctgcaattcgtctgctgacattagccacgccgatcgtccgcatctttcctttgatttcttcatccgaagccagaagctcctccaccttatcacggctcatcccaatcccgtcatcaactacgcggatgaccaggcattcctcttctctgcgcgcctcgatgcagagccttcccggctcaattttacccgccagcccgtgaaaaatcgcattttctacaattggctgtatcaggacatttggcacctcacagtccagcacatcctcatcaacctgataatctgtctgaaaacggtccggataccggtattcctgaatcgtcaggtagttcctgatgttcttcacttcctgcctcatgctgatgtatatgctgtccttttccacccgcagcgtatcctgaagcagagatatgaacgcattcgcaaattttacgatatcggtgtctcctttcatctgtgccatatacacgatggagttcagtgtattgtagataaaatggggattaatctgcagcataagcctgttaatctccatttcccgtatatttttctcatgctctacagattcttccagcagattctgcagatcctgcaccatactgttaaaagagtcccccaggatctcaagctcatcattagtatgtatatccacttctacggcaaaatcaccggtacgcactttctcggcagccgcatgcagctgtcccacaggcctggtaatccggttgataaagtagtagatcagaacaaccagcagggtaatggcagccgcaaatgtcatcaaaaaaagcttctgcattgtggatagcttatttccgatctgatcgctgtacacctcggaaaccatgatccagccgtccgagaaacttcggttgcagagtatcacattgccgttttccagccggtacttactgttttcattttcagcgattgcatcatagggcagtgtcagcttcccactgcctaagattttatttccccatctgtcataaagggcataccccttcagcagattgtcatccagttccgccttcgcaatcaactctttaaaatccacatggatgatcagatcccccatgacatcccgtccgttctggatgtccttaaatgtcattacataactaatcacatcgctctgccacccggcttgcgaagaaagataggagtgcagcgtcgtaaaacccgactgcacatcatgcgctttaaattcctgataccaggcttcctcttcctgctgaaacacactctcatactggttagtggaaaatgttttgccgtccggagtgatgacaataacactgctcaaatatggctgcatatttgtataggacgaaataagccgccttactttgtcatggctgaccaaagccgcaaagctgtcctttgtacggctctccttgataaggttctggagttcggataaaatgacgatctgttttgccacaccttccacagactcctgcacatactccagctgatggctggtctgctccaatttctgctgctcgtccataataatctgttcttccattgtcccaaacacattgtggtatattacaaagctgctgatcccgtaggtaactgacataatcagcagcacggacacgatcagtttaaattttaatgtataccgcagtctcatatggctgtcccccctccctgatcatcgcagccggcgcgcatattcactggggctgattccctcatatttcttgaatacatagctgaagtactggctggacgtgaatccggccttctcataaacactggtaatccgctcgccgtttttaatcagctctttggcacggttgatgcggtattcggtcagataatccacaaccgttgttccgatctcctgcttaaaacattttcttgtatgaccctctgagagctgaaccgcctcagcaatatcctgcagggaaatgttttctgcataatgctgctgtatgtattccagaattaacaatacttttctggagtactgtttttcatcctgctcacgcaggtggtgaaatatatcggatactattttctgcatatattccctggcctctccggcggaataaaattcattttgcaccggaatggcattgaaatccaccttttttcgcatggcatatctctttatcacaccgtgcagttcctgcagcattctggtgaattcctgtatagtgtaagccgcagcctcctcaaataagcggtcaatcaaggcctttgcctctgtttccttctcaccatccaaaattccaacgaggtcagacatataaacttccgtctgccggtccgcacgaagtacgttttccacatcgctctgatgataggtcctgtctcttcccatacagagcatatgctgggagagcctggaaatacgcctgtaagcctgcggaagatctgtaaaattccgaaagacatctgaaataatggcagatgccgggatgcctgcctccttatataactgcagcattttctctgccgactgttccagcagcaccgtactgtcggacacgacttcatgaatgaagaaaacagcggcccacatttcctccgacagcctgaccgctccccggcaggtgatgccctccgggtattccagttcttccagctgcatgctttcaaagtttacatgctcctcatacaccgtctgcatacaaacaggatggatccgcttcaccgcagtcagggcaaatctgttcagcgtgctgcctttataaatattttccatgccttctgtccggctgctttcgctttccagaaactgcttcagattatattcctgataggtatggagctgctttctttccagcctgacctgttccataatactgcggatctctttgcctagactttcgggggtgagttcatttttcagcagataattactcaccccaagctccattcctctcttcacataatcaaattcccgataggaagtaagcagcacgatgatttggtttttattctgctgcagaatccgctctgccagaaccagcccattcataaccggcatgctgatatctacaaatacaatatccggctgtacctttgggatttcctccagcgcagtcggaccatggagagcctctcccaccactttgcaggcaggagaaagcccttctattaatctcttaaaatactcaatcgccatcttttcgtcatcgacgatgtaaagcttcacataattatccataagaattacctcattccctgtaattcctctattgtaccttattctacagcctgctgcaaaccgagaaaaactctctttgtcttctctagcctttaacggcacccgcggtgaggcctttaataaagctcttggaaccgcagatgaacatgataagcagcggaattgttgcaaggagcaggccggaaagctgcgcgccataatctgtacggtaggcattggccaggctcttgataaagatcggtatcgtgttaaggctttcgttgttaacaaatacaagcggtaccaggtagctgttccaggaccagaggaaaattaaaaggcacagtgttagtacgcccggtctgatacaggggaacaccattccaaaaaagatcttcagttctcctgccccgtcaattctggcgctttcaacgatttccatcggcatggaaccattgataaactgtatcatccagaacgcaccaaatccattggcaaaccacagcagaatcatgggccataatgtccccgtcaggtgcagggtccgcatctcgatcatatatccgatgataccgatctgtgtcggcaccatcatggtcagcataataaaattcatcagcgcttttttaaacttaaaatcatagacaagcatggcatacccaaccatagcgcttaccagaacacagactgccatggaaactacggagataaacaggctgtttccataggactgcaggaagttggactgaaacacggttgcaatattcttcccgaaataatcagatggcagaaacggcatgctctggaatatctgttccgttttgtacgtcgacattgtgatcatcatgtaaaaaggaaacagggaaataaatgatatgatggccaaaatgacataagataatgaacttgttaactttttcatttattttccctcctttttattcatcagcttcatgccgaccagtgatgtgattacaataataataaagagtgttgtcgcaacagcagagccgtatcccagtcttgctgtggatccaaatgccacgtcatagaagttccacaccattgtcaggcatgatctgtccggtcctccgatgacactcgttgtggagacgttgaacatcaggtttggttcgtcaaacagttgaagtgcataaattaggctcgtgatcacaataaatattgtgattggttttaaaagcggcagcgtaatcttaaaaaatgtttttaccggacctgcgccgtctacctttgctgcttcgtatatatcctccgagatagaagtaattcccgccagatagagtgccatataatatccggtcgttttccagataatcataaatccgataaccagcggtgcgaatttggcattgcccagccagttgatcccctccccaccgaaaaatgagagaattttgtttataattcctgtattccagtcaaaaaggaacgtgaagatcaggccgattgcaaccggtgtggtgatgtaaggcagaaaattaattgtctgaaatacattacggaattttttcaggttactcaagaatgctgccagcaccagtcccaggaagatggacagcggaaatcccagcaccatgatatacagcgtattccccagtgatttccagaccgtcttgtcctgggtaaagatgcgcacatagttgtccaatccgataaacactttatctccgattccactccagtcatggaaacttaaaaatacagagtacagaatagggaacaagttaaatgccagaaagaagatgatgaatggcgccacaaaaaataacggccataagattgtatattttttattgcctttactgttcatagatatttctccttacattttgccggcatgtttcctgccggcgggcttaaaaaacggaagggtgtccgtttcgggaaagcactcttccgtttcacttccattttgcttattttaccttaacgtcactgtctgtaatacggtttgcacattcctcaaggcccttatcaatcagtgccttggtatcaagacttgaatccgacattaccgcatttgccagcaggtcacggatatcgatgactgtctggtcgtagattgaaggagtcgggatgacgatgctctgtgcgatttctccatataagaatccgcctacatcctgtcctgcaaagaacggatctgctccggacgcataggaagcatcttcatagaattcttttgttggtacatagtaatctgttgcttcttttgcagtatcaacaccgccctgctccaggaatgcccattttaagaatctccatgccgcatctttctgtgcatctgtacttgtgtttgtaatacctacggaacatccgccgcagctgtaaccgcctgtagctggcatcatcaggccccagttgccttcgccgtcagggtcattagccttgatatagtaagagattgcccagttcggacaaggatagaacaggtgcttgtcatctgcatatgtagcatttgcctgtggagtaccattttcaaatgtatccacaaccttgttgtctctcatcttaacaagtgtgtccataaccggagtcatcttctctgtaaagtttacggtatcccctgtctgaagttctgtgctgtctgcaaagtacagccactcagcaacagcgccgctggaatggaacaggtaagcatctccgcctgatttttcattgacttctttgccttttgtaatgtagtcgtctgttgactggaacagtgctgccagttcttccggatcatctgttccaaaatattctttcgcaagatctctcttgtatgcaattgctgatggagatacagactgctcaataccgatcagctgtccgtcttctgtcattgctctgtctttgataaagtcaaagaagatattcggatccacattgtatgggtctgaggtcagatcctcgaacacacccagttctttgtagtttgcaatcaatgtacagctctgctgaaccatggtcggaagctctgatcctgaagcaattgcctgctggatctttgtaaaataatcgctgtatgcaacattggtagcctcaatcttaatatccgggttctcttccataaacttttcgaacatcggctcataccagttcgtgtcccatccccaatatgtaatcgtagttacatcaccttctgcttcctgctttgtgtctttgctgccggagtcactctttgcagtatcttcggaatcactctttccgcaccctgccagcattccaagtgccagaacagctgtcatagccatcgcagttactcttttcaatttcataaattctcctccttgccctcatttaatatgggatttcttttgttaaataaagattaacatgtccgaaattatttgttcattgcaaaattctttcattttgttagaaatccgaacatgtgatattttttactgcaaaggggtctgacccctttgcagtaaggacgctccctttgtatccgtcggattttctcagctgcatagaatctcccggatcgctctgtttaaaggccagttggaatatgcgctgacctgcaccataaacaagaatactgtctgcttctttgcatccacggccatatacgctcctgcccagccgtcccagccgaattccccctgtttcccgccaatgggagaagcattttcatccatcagcacccgcattaggtttccgtatccgtatcccttcatatgttcaaaataaatggattctgtctgcgtttcccccagttgattctgcataaactgttccacagtttccgctttcaggatccgcaccccgtccaaaatcccctgattcgccagcatcatacaaaaccgcgcactgtcatccaccgtggataacagccccgcccctgcagattcaaaagccggcggctccaggcattttgtaagtcccagcgtccgatcctcttccaccgccagcttcacgccattctccgtctcttcctgccggtacagctgggcaagcctgccccacttttcccgtggcacatagaatcccgtatccaccatacccagaggctcaaaaagctcttttttatagaactctcccaatgtcatccccgacacaacttccatgacagcccccagtacatccgcacaaagcccgtaccgccatacacttcccggcacattagccaaaggcttttctgcgatcttttgcacaacctctctcgtactataccccacaccatctctgatatgcgcatgaatatcctcaaatagccccgccatctcctgtccggccgcatcctcgtccggatatacaatccccgcagtcatattcagaagctgtctcaccgtaatggtatacggagtctcatcccccagaacatacatccgttcatattccggcaaatacctgcagaccggagcatccaggtccagcagccctctctctgccagaatcatggcagccacagcagccaccggcttgctcatggaatacagccggaaaatcgtatcccgctttatgagccgggccgtatccctgtcagccataccataagtatcaaagaagacttccttccccttctcataatagccaatcagagcccccgcaaaatgctctttctctatctcctcctccatcaggcggcgaagcctgcgcctgatttctttttcttccttccaatccataaaaacgcctccttttcccctaaacctgttgcggcaatgaattttcaaacacgctttagcataacgccttaccgccttgccgtaaagtaaaaaatccgcgcataaagtacaaaatacggaaatagtgaacggactttgggagtgaatggatgggggcgcgaagtaaaaggtgaggcggggaagctccggagaggggggcatcaagtcggttgtcaagatccgcttcccggagggatacctaatacgggagcagcggatttaaactggctgtacgtagctgtatcctatactccatatcccatccgccgcccccacagacttcctaaaagcgcccctcccctttggatgcgcccagcctgtccgggccgtgtctcctgccacagcgggaaacttccatgcccctttttcgctgcatagagtgcgccgtactgccgcttgataaaaaccacaccggattggaaggctaaatgctgcttccgaagcagcatttaaggcggcctgagccgcgcaattcatcagaattgcacggtgaatgccgccggtgcctcccaatccggtgtggtttttatctagtggcagtaggcaaacggaccgcagcgaaaaaggggcatggaagtttcccgctgtggcaggagacacggcccggacaggcgtcctccccccttaaatccccgcctccgctttaataatatccacataacgttttgcttttttggggtcgttatttattgtatatacgtctctctgtgtgatttccagtttacatccttcggatgccttcatcgttttccgtatactttctcttactgcttcctcgtccagcacagttcccactccaaggtagttcggggacggcttcctgtggaaaatagttttgctgcctttaagccgctctcccatatattcttcgttacaccatggagaaatagacacttttctaagattctctagttttgagatgcagttttcccagatcggatccaccggttcacagcatccataggacagaaggccgtattgttcggatattttcttataacatgggaagataaactcttcaaacatctccggtgacagccctacagtctcctgggaatccatgaatccccagacgtcccgcgttgtaagtggacgtatttttgcttcttcttcacccggcagttcacggttgtagcaccagctgccctgtcccagactctctcctccggttgttggcaaaatcagatgcttttcttccagcatccggtaataagcaagcgtatcgtctgcaatacggttcatcatttctttgaaaagttccggatagtcatagatattgaacatcatattttccatcttcataaaatgaacgatcatctgtgttggcacgctgtaaaggcagtccatctgcaccctgacagggaggatatctccaaaggcttcctccagcgcctgctttttcagcatggtggactccatatccaccccgtaatctgttgcctgcagtttcacgtagtcatcttccagatcttccacaaccgatatgaactcgtgcccgacagaacccacactgttgtgtttttttattggaatattgaataaggtaaaatgggtatcgtatggcagcggataataatccggggttacacgatcgtcgtcaaacaattcctggttcaaaaaattgcagtacagctttgtctctacatccctggcaaattcgcccttgcactgcaggcgctgggggatgatttcctgcgcaaacgtccacaactccagatgaatcatggggcgtttcccctgcagtgagttgtgatccgtccactcccggattctatttttatttttttcagtctgagagtattcatactgctttttagccaattctctcaaaatcatgcgatctttcccatcaatcatatatctttgcatacgacctctccttttttctcccgcctgccggtatcccgtactgcggaatgttttcacggttttctttaccgttttatcttaccctgttcctgcgcgtctggcattagatttctttgcccatttatatcaaaaaattgctctgcataatcttgacaagtttttaatcagatcctataattagcaaaacaaatcctctaatgccacattgagatttagcctaatcgtgcactagcataatacagaaaggcagagcatatgagccattcatttaatgaaggggtttcccctaattccacaatctattttcacacgcccatgaactgtattcctgattttttatattatcccttatgtatcgggcatttttactgcagcgccgggtataaagttgacagaaccagttatgacagttttctgcttctgtacacaaagagggggaagggtaccataaatgccggcggaattaccagagagctgcatcccggcaagatatgccttctggactgttactgcccccatctataccagacatccgaagtgtgggaactggagtggattcattttgacggcggaaacagccgcgccttttttgactatctaagagacgatatgccattcttctatacacttctggatagtccggcccaattagaagccatttggaaccgtttatatgaaacgcttttaaaaaagaacaacatcaatgagctgctgatttcccaggatatctcccagatactcacccttcttggactttcaaaggagcgccgggaaaagcagaaaactgcatctgattttatggatatttcattgaaatacattcaccgccacctggacgaagacatctcgctgaatgcacttgctgcccgtgtttctctgagcccattctatttcacaaggaagtttaaagaagaaacaggatataccccttacagatatatcctgatatcacgcattaaccttgcaaaattttacttaaaaagcagccgggatacggtaaaaaatataggattcagctgcggctttcacagcgaacacagcttctgtactacatttaaaaaagaagttggcgtaacaccgactgaataccgataccgttcagaataacttaatcttagccgtcttccctgcgccttactgcagagagctttccgccataatgcgggaccagttctctgcaatttccatacatccttccactgaaggatgtaccaggtcctctgatataaattcctctctgtttaataattccaatccgtccgtaaagatcagcctcttagaagcgtattctctcactatttctctgtaaacttctataagctccttgtcaacataattgtttccaaagatatttgtgcagtatatttttcttgaatctgaagccaatatttcgataaattttttcactctatcctcaaaaaaacgtgtggaaaacctgccgtctgtcatgttaattcccagttccacagaggcaaagtcccagtcttttctgctgacaatgtactctgccatctcctgttccaaaaatgcagttcccgcaaatcccagattcagataatctgcacccagcctgcgggcgatctgaaagggataggagcagggcgcagacaatgccaggcttccatgggtgatagaagaaccataggcaagatatgtcctttgcggcagttccgctttctgcggcggctgtatatctccgattatttctttaaaatagcaggtgccgtatggcagtatgatccttacgatttcgggatggaagggcagcctttttttctctgtaagcattttcagcagctctatattttcagcctttttaatttcaattgtagtaccatcctctgtaagtgcagcggatgacttctgccatcccccctgaaaggaaccataataaataaaagcagtctgggcctcaatatctttctccgcggacagcattatttttacagtatcactttgcatcctgaatctgatttccacccctgtggtaaagcggcaggagccgtttcgcgctccttcatttaatttttccgatacaaaagaaggaatacgctgcatggcataccccttcctacactctataatttcctccacattatgaaattccatatttttgaatatcattgctattacctcctctcccattgtgtcttcactttaacactgccgtataaggaaaggaattacgagatccgaacaaattttataaataatgagcataagtttagtacccctgttctaatgtatctgccgggatatcgtactttttacttacttatgtcattgtcaccgtcctctgtctttttaccaatatgcttctcgtccatgctgccggaacggaatccttccagatccagcgcagcataccgatatccaagtttcctcatgtactccataatctctttatggtgctgcagcgcttgtcccagggacgcctcatccacctcaatgcgggcaacatcttcgtgaacccgcagacgtacattgtaaaatcccagagaccggatgtacgcttcccccagttccgctgctttcattttctccctgtccagtctggttccatagggaaaacgtgtcgccatgcatggagatgccggacgctctgccacagagattccgtaggcagctgccagtctgcgtacctcttcttttgtcagccctgcctctgccagcggactttttatacctaattcacggattgcccggatacccggccggtacatgccaagatcatctgcattcgtcccctccagtatgctgcccacccccagccgggaaacttcttcacgtattttggtgaagaggagctttttacagagatagcatctgttttcggggttattctctattcccgcttcctcgagttcattaacataaaggactatatgaaatgctccagtttcttttgctactttttcagctattattaaatcattttgtgtgtgaagttctgtttgtaccgttactgcataaacctcatttccctgctttgtggcacactcgcatgcaagcttcagaagcaggctgctgtccgctccgccggaaaatgcaacggcagtatcctccctgcaatatttttccattgccgtaaacagagctttttttcttttatctaacaacacgttctgtgcatcctcatacatctccatcgcactccctcacaatcaaccggtaaacttcctgccatgaaagtccgcttttcctgctcagctcggccacactgtcatgttccgggtatatcctttttcctgatggaagcgcacaaatttttacggctgcccgccccagagaagtcaccacctctttttgctcacgttttaggattgagcgctccattttcatcctccggattccaatggtcgttgtttccatgaacataacctcttccaactttgtgatatcttcctctgcgcagattacattaatctgatatgcaggacggttctttttcatataaattggagtaaaatatacatcttttgcgcctgcctccaggagtctctgcattacgtaagataaagcctctcctgtacagtcatctatattactttcaagtttacatatacaatccgtttgatcctgctccgcctgaatcagcatcgcccggagcaggcttggcctttcatatgtccttttcccagctcccaggccggttttcagaatcgtaaacttctccggaagccggtctttcgttctgaccgctgctgctatagccgcaccggtcggtgtcacaaattcaccctccatattatgtatacgaagcgtcagggcatatttctcagcaatggccgcaacagccggaaccggaacaggtatcataccatgctgacagcggacaaatccggttccttcattcaggatcggaacaatcacctcttttatatccagattatccaggcatactgccgctgcaacaatatccacaatcgaatccacggcgccaacttcatggaaatgcacctggtcaatagaaactccatgagcttttgcctcagcctctgccagaatctcaaaaatacggacggccgtgtttctggcgtaatcactgagatcagcctgttttataaccgccatgatatctgccagccccctatgttcgtgcgtatgctgatgagagtgatgatgtacataactatgctcggctccatgcacatgattccctgcatccgccccatgcagatactccatatcatgatcatggttctcatgttccgcatccagatgaaccgaaaagtcgcatgcagccagaccacttttcgtaacccggctgatttccaccctgtatccgggcagccgcagactgtcaagcgcctttctcagtacgtcctgatcagcgcccagatcaagcagcgctgccgtaaacatgtccccgcttattcctgaggcacattctaaatacaattccctgctcatattctctcccccaatctgttaatctgtgtagcgatatatcccgccccatatccattatcaatgttgacaaccgcaattccatttgcacaggaattaatcatagtaagcagagccgacaatccatgaaaattagctccataacctacggacgtgggaaccgctatcaccggtttgtccacaagtcctcccatgacactggccagggccccctccattcccgccacggcaaccacacaatttgcacgctgaatcacatccagacgggacatcagccggtgaatgccgctgacccccacatcatagatacgttccaccctgcttccaaaatactctgcggtctgtgctgcctcctcagccacaggaatatctgccgttcctgctgtacagactgcaatcctgccaacatgatctttttccttcttctctatcttcataatccgggagatcgggtcatactcaagttcaggcagtgtttttcgcagcaactcaaactgttcttctgtagctctggtgccaaacacctccccctcttcctcatataatttctgataaatatgaagcagatgttccgtatccttaccgctgcagaatattacctctggaaatcctgaccgcagcttcctgtgcgtatccagtttagcataccccagttcctcaaatggctcacggcgaaaatactgctcggcttcctccacagacacttccccactcttcactttttccaacatttcatgagcatccatcaacatctcctccatctgtaattgctatctttttctattataactgctttttcgtttttttgaaatatactcacataattaattaaacaatattccacagcccatgtattacggggtgccctttgggtatacttttttccacagattgacgcaaatctacctgcaaagcaaaagtcccaggatacccctaaggcaagcttccctcgtcgactcctccaaagttttgtccctcccgcccggatgcgcccatcgggtgcagtcccaaacttcctggacaatatcccggtaaaattcgggttcatgacagatcagcagtatcgttcccctatattctttcagcgcctctttcagggcctcttttgcttccacatccagatggttggtaggctcatccagcaacagcacatttgtctcccggttgattagtttgcacaaacgcaccttcgcctgctctccaccactcaacacccggacctgactctctatatgcttcgtagtcaatccgcattttgccagcgcagatcgaacctcatactgggtaaatgaaggaaattcactccagatttcttcgatacatgttgtcttgttgtttccgtctccctcctgttcaaaatatccgatggaaagattctcgcccagttcgcagccgcccctcagaggctttacaagtcccatgatgctgcggatgagagtggtctttccaatcccattggcaccggtcagagcaatcttctgtcctctttccatgaaaatatcgagtggttttgacagtggctcatcgtacccgattacaaaatctcttgtctcaaatatatattttcccggcgtgcgcccttgtttgaaatgaaattccggtttcggacgttctgccgccagctcaatgacctccattttatccagctttttctggcgggacatagccatatttcttgtggaaacccgggctttattgcgggcaacaaaatctttcagctggctgatctcctgctgctgcctcttgtatgccgcctcaagctgggactttttcacctcataaaccctctggaaatcttcgtaattacccacatagcggtccagactctgattctccatatgataaataatattgacaacctcatctagaaaaggaatatcatgtgagatcaatataaatgcattctcatattccgtcaaataccgtttcagccagttaatatgttcctcatccagataattcgtcggctcgtcgagcagcaggatatctggtttctcaagcagtaatttacccagcaggatccttgtcctctgtcctccgctgagatccgccacatcccggtcaagtcccaagtcaagcagccccagtgcgcgtgccacttcctcaactttggcatcaatgacataaaaatcgtgcagcgtcagcgtatcctgaatcgtccccagttcttccatcagactctccatctcatccgcatcggcctctccgagactttcgcagatgcggttcatcttatcctccagctcaaaaagataagaaaacgcagacttcaggacatctcgcatcgtcatccccttttccagaaccgtatgctgatccagataaccaacacggatatccttagcccactcaacttttccttcatccggtcggagttttccaattacaatatttaaaaatgtagactttccttccccgttagcacctatcaggccaatatgctccccccgaagcagccggaaagaaacatcctgaaaaatagcacggtctccaaatccatgggagaggtgttcaacatttaagatactcatacaaaatctcctttactttctctatttcatgtactcctcagacaccccgctaccttgcgggcttagcaaaacgctcataatacctgctggactcttcccggtttaatgagaagcccctgattaacttatccaggattatttctttgctgtatccttcttctatataatcctgtaccaatactttgattcctttctcgatccccttctcgagtccctcttctacgccatcctggtataaatcttccaacgctttacacatattaacgttccctccttcttccgtctttaccgttttcaaatgttgtgtcgatcccagcattgcacaaacggcattatatgaatcctgatcaacctgcacaaaatatgccctgttattctgcacatagcgtttcaattcttctttgttttttctacattttaacatgccaaatatcatctgtaaatctgtttgaaaacactccaggttttccagctttttcgggtctatcaggttgatcctgtaattcggtatgtacttcgtcagcagcttatactcttttcggtctaatcccaataatccatgcagatccgtactcccatcccattcttcttcaccatagtaaaaaacaatattcagaaccggcgacaaaaaatctgtcctcttcagaccggaaagaaattctgccgatactttcatatctttcttttccttatgatttttccgcaattcattgatctgatctgcataacttaaggcatcatacaacatctctcgtacaggcatggcatagctgtaaaataaggtaaccaaaaaagcatatcgagacccattccatactgaaggatccgcagccaagccataaccccggtacaactctctcttcccacgtaccgagtctaagccgtactcccaccgaatcaatacgctgccccctaaaagtatcctcccaagctgccaccctatccaaccgattggatgcacccagcgaaagaaagggatagccgcaagccgcccaagtgcacatatgccgcctcgaaacgctaaagccaacctaagaaattctaggaagccggcagccataccccactttcccggctgccggcttcctagaatttcttaggttggcgtccgcatttcgaggcggcatatgtgcacttgggcggcttgcggctatcccttcctttcgcggacaccattccccaactcctacgtatccaaaaccttccccctaaaaacccgcaccgataccaaataaaccagtgtaaatataaccagtatagaaaccgcgctgtaaatattcacacggaacaaatcttctttcattacatttcccagtgcacggattgcaaaccaggaggatactgccatgagaacaaacggacaatagtaagtaaaacgtatctcatttttcatggacttatacagcgtgtcaccggcgattcctagttttcgcaggatccggtacctgtcacggtcctcataggcatcattgttcagcttgatgaagataatactgcctcctgccaggatcagcgtcacaaacataaagatacatagggaatacaaaacccgtatccatgtttctttatcactatcggctcccgaaaagttaactcccacctgcatctgcccgttttcatccgttttggaaaggctcctcaaataagtcctggatgcgtctgcattggacggatcctcaattttgaagttatacatgtgcagcaggattcccttaggctccagttctttataaacctcatcgttgagtacataaatgctcatctgctcctgcatggcgcccaaatatggggtatcgtcttccttaataatacgataagaattgtctccgatctggacgtcctcttgctcctgcccagcaaagctcatgagaatgatgtgcgaaagtttaattgtctcgtcctgattcaattccgtgtaatcaaaaggcatgcccgcctcttccgcaatagttttcatttgagagaaagggatgattgcataggtagaattcacatatttcgtatggaacatactcgggtcaagaagcagataggatgcctccgccttatattccactttattctccttcgatattccctcttcaatctcctccatatccatctcatgtgagcttacgacctgatatgtgaaggtctcttgaaaatgcaccatcttatcatagcgctgctttagggcgatcgctgtacccagcaccgttacggaacagatcatcagaatcgtaaccatggcataagtgcggtaatttctccggattctgaaggacagattattcacccaaaggctgcgctgcttttgatacagaaatttcttgtttttggtcagctttctgatcaagtatggaattgcaccgccaaacaacagatatattcctgcaattaccagtattacagcaagcagtgcatacgacagagtatccagattcccggtttttattgcacacatataacctgcgcccaataccaccactcccgctgcggatttcagggcggccatccatcctttttccggcttcatttcttcttgctttgcaccggaaagcatactcagtacgctgctcctcgatatcgatacatatcctttcagtatcatcatgctaaatatgataaagaatacggctgaagtgataagaaccggttttatagtgaatgaaaaacggacatccacgctgatctccgacagcttcatcaacagcatctgaaataattttgaaaatgcagtcccggccagcagaccggccagcagggaaaatataccgataaaaaatgcctcaagcgcgtacattttaccaatgcgcacattatccagccccataaacgtatagattccgatctcttttttcctctggttgagaaatacatttgtggcataccagatgaaaaagaacaaaaacaccccaaatactacggatgccgcatgtacgaccaagtcaatgtagtctttgttcatactgttcagtacatccatagagtccgaatagataacattttgaaagttaaaaaatataaaaacagaaaatgcaagggacataatcagtgccgcatattcccttacacttctcttaaagttggaaaatgcaagtctgcacaaactcatctaccgttcacctcccatggaagcaagcagttccataatctcttcataaaagacttttctgtcccccatgctgttcaaccggcactgtacctgtccgtcagaaagcatatagacctgctttgcgtagcttgccgtataggcgtcatgtgtcaccatcaggatcgttgcccgcccggagtcattggctgctttcaggctctgcagcagatcccggctggatctggagtccaacgctccggtcggctcatcggcaaagataatctttggctccgtgatcagggcccgggcacttgcccctctctgtttctgccctcctgagagctggtaagggtattttgacagatgctcctccagctggaagagctttgccatattcatcacccttttctgcacctctcggctctttactccattcagggacaacggcagagcgatattatcttccagcgtcatattgtccagcagattatattcctggaaaatgaaaccgatcttatccctgcgtataatggacagccgtttattatccgcttttgtaacatcctccccatccagaaatatctgccccctggtcggtttgtccagcgtagagagcatattcagaagagtcgattttcctgcgccgctcggccccatgatggcaacaaagtcctgctcctgaatgtccagattgattcccttcagaacctgggattcataatcctttcttccgaaactttttactagatttctaatttccattatttttttcatatcatgaatacctccttttatcactaaaattgtaacaaaaagagggttgaaaatcctttcatccggataacagtcccctcctgtatctaacatttctgcaagattgccggattattgcaataccatctgccaaagctgcgttcattcttctgcctctctctctgcatctatgttcaaattaaaaaatgctgtattatttgaaaaacgaagcgtaaaccgggtgccctcccccggtctggaatatacctgcagccggatcccgagatgtccggctgtctctttcacgaagtaaagccccatacctgtagagcgataatcaccgtttctcagattgcttccaatataacctctgtcgaaaatgtaaggaatctcaccttctgcaattccgatcccgttgtccttcactgtaagcactgcttcgtcagctgaaatacatcttgcctcaaagttgagcgccggctgttttgttctgtattttaccgcatttccgatgagctgatccagcatatagacaagccacctccggtcactgtaaaccacagcgccctcgattttcttttcaatctgaaaatgctcccggatcaggaaataagactgattcttcagagcctcattaaccgcttcttccagataaaccctctcatagcgtacatcattttccatatttttcagtttgctgctcatcatcattgtgtttaaaagctgctgcatccgctccagacatccctgcatctcctcctgcagttcactgtcggggttcctctcattcatcagtcccaacgcggagagcggcagcttaacttcgtgtgcccaccttgtaatgtagtcggtcagtccctcacgctcctcctgcagtgcgctgatatcttccgcattttctttttccatcctgcacagcacttctgtaaccctgccgccgagcagacggctggcttcttccctgttcttatgtatttcatcgtccagaatgcgggatatctgcttccattttctgtaatcgagtgcaaagtaaaaaagccctgcggccagaaggatcccatccagatacagcaaatccccgaaatttacgctgtgggcgcacagcaccccaaaatacagattgatggcggccaggactgccgcccctgccagaatgccccgtctcttctctttgaaataatttttcattctatataataccccataccttttttcgttacaataatttcgcttccccccgtaacttcattcagctttgcacggagccgagaaactagaacactcagcgaagcatccgtcacaaactcgtccgtattccacagctgctgcatcagcttctccctgctgaccacactcccttttttggagagcagcgccgccatgatcttactctccgactttgtcagatccacagtcattccgttgcatacaaactgcccgctctcataatacatcccgccgttcagataggttctctcatttgtagtgtactcataagcccggcgcagcatagcccggatcttcagcaggagcagctccgggtcgaatggcttttccacataatcgtctccgccggctgccatggccatcaccttatccgcattctggtctctgcttgaaagatacagaagcggtacattagaaatctggcgtatcttttcacaccagtagaacccgtcgaagcttggaaggttaatatccatcagaatcagatctggctgtctgctgatgtattcattcgtaatatcatcgaactgtttcgcgtaaacagcgtcaaatccccaccgttcacacaacagcaccagttcctttgccagcgtcatatcatcttcaacaatcagaattttcattttcaccactcccgaatacattatcagacagcataagtctgcgggtattattttatcataaccgcaggcggtcacgatgcctccggcggatacgcagcagctttctgcggttccgcagaaactgccgaatgcgcaatgatacaatgtacgctctgcgtacattgtatcatactttttctcctcatcagtcctctataacaaaaatgttagaaatataccacttctaattttatgaaaactcctgttcataagaagcctgctcagagatgagatgaaagatctgctttttccctttccacaattgatattccatactacaggccggactctcttttataatccggtccatactcccctcataaggagccctgagtccatgagatttttccccgagtttcctaattttcaacaggagctttccctgcctcagagtcactgccccctcacggtattctgtaagccgcgccccataataagttcccattcggtattccctgccctggtaatgaaccgcagcaatacatcctctaaagtgcattcccaggaaaggaatatccgcaacagaagccataatactgttcatttctttctgaaaacattcctttgtcttcttttcgagtgcatactggcgcttcccgtttctaaggcatttcttcttttttgtttcctgtattttcccgaatccgcactgggtccagagatatgtttcaggaaaagattttcccctgtccgtttctatataacctcttcccccggtaaagtccatccgtttcccgttgaccctcagggaacctttcagattatgcgccatacttaacactccgtggctgcactgcataaatgggcaaaaccggaacggccccatgatatctcccctgatcttatggaaacccgagtaggctatttttccctccacagtgagctcttccgtgtgtatactgattaaggcccctttttcagtaaataaattttctccgattcgcacctgaaatttatcgtcgtgaatctggcacatttcgatcggatacgtaaagttccatgcgccatgatccatggccacctgaatggaagccgtccagtttccttctttatctgcgtgtacagccggaataaatgcaatggttttccctttattctgatgcttcagataccatccctcaaaatagggcccttttttccctatcccatgaaaatactttaccttcatctagttcccctttctgatatggcattccaaatcattctgtgccggaccgtccagccgtttcccccgataatcaaaccgtgatccatggcaagggcagtcccagcttttttcatcgggattccatgcgagctggcagcccagatggggacaccttgttgaaattgcaaagagttttcccgtttcttctctgtacactccgtatttatttccgtcatgctctacgatcccgccatgcccaggacgcagatcctgaagcttctcctttggtattgcagccagctgtttcataaggccggaaacagcatagccgccttctttgattaaggtacccacggaagactgcaggtgaaagcgtctgggggtgaatacatccgcgtattggttttgccgcccgcagatcaggtcagacaggatcatggcagataccatggagctggtcatcccccatttgccaaagcctgtggccacataccagtccggctggctcttactgtactttccaatatagggaatcccatccagtgtcatgcagtcctgtgcagaccagcgcgctgtttctttacatcccggccataatgcctccgccctgctgcttagatattcataggatttcccggctgtatttttgccggtgcggtgccccccgcccccaatcagcaggttttctcctgcgcttctgaaggataatccgtcctcatctataccgtaatacattccctccaatgaagcggcctttttcaccgccagcacataacttcgttcctgatgcatacgcataaaataatatcccgggctgttcagaaaaggatagtggcaggcaaacacgacccgctgcgcatgtacggttccatgcgctgtcaagaccgtatgatcctctacatgagttacttttgtatgctcaaatatggtcagttcctccgccagcatatacaaaaaccgcaatggatgaaactggccctgcccctctagtttcagggccagtttcacctgaaacggaagttccgtcttctctgtcagctgcatccccagcccgatccgttttgccgcctcatgttcccgccgcagcgcgcccgtatcctgcatggtatacaaataagcaggacactggttccatccaatgtccccctgatacttttccgccagaatccggtaccgttcaaccgcttcctgattcgcagcggcatacagccctgccttttcagtcccctcgttctgcagcagtctgtcgtagatcatcccgtgctgggaagtcaccttcgccgtggtattctttgtctgcccgctcccgattctgtctgcctccagaaccacgcacttcatacccgcctgctccaaaaaatgagccgtcagaaccccggccatccctccgcctataatcaccgtatccgtctcaatatcgccctgcagcggggaacgcttggcagacgatgcagaaatactccaaattgacttttcaaccatactattcacctcaatacattcttctgaataggatgcgtcttagatgcgggaattatacaaaaactgggaaagaattggtgggggaggccgcgaagtgaattgcgggcgaaatgggcatcctccccaacatctccctatcatatacccgtcaataagtttagcttgtctttattgcggtaatgtggtaaattataaaagaaattatttttttgctctatccaatcagtaataactttacttgaaatcaggttaacaccaggctcacttacatatgcctgccattgtatgaggagtaaatcatgaaaatctcaacttttactaagacaccatcgtccggacgctttttatgcaatcctacctggtatattgatgcctgcgggaaaaagctgctgtttgtttcctcaggctcaggatctttccgcagagacatatctcaggcggatacgattcttaatgatattgatattatcattcttcctgccggctgcattgagccggtcagagaaattcagtattttctgtttgcaagccctcatgcacagttctatcttcccaaagctacatcgcaaaaatattttctggatatattccataaattaaatgggtactgcaaaaccgagtaccaatatggaatgctttcacgcattcattttgtgaacgacctctgcagtattaatcagaaccttatgctgtttggatctgatccttatcccgctgattctattgaacacaggcagagccttctgatccaggaagacagttgtgccgtgctgtttgcgaatactggcacggggacgcctgccctggaggccaccttttcccgtgcccgagacctgacctgcttgaaaatcaaacgtgttatcatggcagccggagaatacgatacgcaagatagggaagatcacagtgaaaaaaaagcctaaagcgcagacacgctctaaacgtaccttgaaattccagtctggctctgtagctacttcagttgctcaatgcggcctgctttaattgcagcgatattttctgcgatcttctcttttgaccagttccaccactgtattctgagcaaagaggcgattgtggcttcagaaaatctctttttaatcgcttttgcgggcactccgccgacaatcgtatatggcgggacgtctcttgttacaacggccctggcgccgattatggcgccatcccctattgttaccccggacagtataacagcctcatatccaatccagacatcattaccgattatgatatcgcctttattgtcccaggcatctgccacatcatttctgtcaagtccccattcctcaaagaacagtggaaacggataggttgagagtgattccattgaatggtttgcgctattaaaaagaaactttgctccacaagcaatggaacaaaactttccgatgttcagtcggtctctattgaccggatagtgatacaaaacgttatttttttcaaactcccggggatctttaacaaaatcatgatacatcgtataatcgccaaccttaatattcggattggtaattgcatttttcagatagatcgtctggttatctcctgtccgcgggtatattttttctggtgctgccatttgaattcctcctgtcctctagtacatcgctaattctgatctgcagacgccgttttatcatatcctctgttaacgacgactgcttattattatattaactttccgaaccagcattctcaatataccagatactacagcagtgtttagtatacattggctttcctacccgaagacaatttgttaatttaagaatattctgaaaatggtgggcaaaagggtctgacccctttataataccggcacccagtattcgatcgggctttttccgtccttatctgctttttctccgtattttgcaaaatcataccgtgcatggtcattcagctggctggtcgattggggaaaccattctttatagacgtaatcagcaaccggctgcaggctgtcttcgcatttagccctgaaactgaagacaatatacttgcatgccggcagctcttttacctccatacctgcagggatattctcaatatggtcaacttctgctgcagccagataatcaaacgccggctgtttttcattttctaaatcccattttgtatagtcattaagcccaatcagaaaatccatatcattcctgtgtgaaatcaattgctttttcgcatgtaacttacgccagcattttccaatattaaaaaaaccaaaacgaacatttttcttgaaacccactaacactattctgccgcattctacggttctgatatccatcatcttgtctcccctcagccttgcctgtccgtcagccgtaaactttaactggtacggataaaattcccgcttcttacgaaacgcctgcgggctgcatttgaacagagctttgaagccggccgtaaaggactgctgtgtctcatatccggcacacaaagcaatttccatgatcggtttgtcagtaaagatcagtgatcttgccgcttcggttaaacgccttctctggatataatgatgcagtgtaaagcctacaatacttacaaacattctgctcaaatggtatttcgaataatgcatcttcccggaaatactatccaggttcaacgcttcttccaggtgctcctcaatgtaatctaccacttcttgaattgtatcaatgttatttgttttcattctgacctcctgaacatattatactgctttttagatcatctattttcacatttcttgctgtcatcccccattttaagatgagttaaacggtacagccctttcaccgcttcctgcctgacattagcttcttgatatgaaggaattatacgcttataataattaccatagcacgaatagcttctaaacagaaaggcagcggcgtgaagattgcagatcagataacaaaaattaaactatgaaaagaacagaaataacagcaagttaaatcaagcagtaattcctttatttctttataataagtatagggcgattgagatgaggtgaacaataatgtacgaatggcagaaacaaattcaaatcatcgttgatgaaattgacaactgtattaaaaattataatgatgacgctttgactctaagctgcctttcccgcaggctgggctattccgagttttattcaaccagaaagtttaaagaaacagcgggcatgcagtttcgggattatctgcggcatagaaaattagcctttgcattaaaagaggtgcgtgacagtgaaaaaagctttttggaaattgcttttgattatggcttttcatcacatgaggcctttaccagggctttcaaaaaaacatatggcgtaactccaagtgagtacaggaagaatccaaggcctgtcgttctccgtacaaaaataaaccctttcgaccgttacttttttggatatggagagataggtatgataaaaactacagatgacattaaaatttattttgtaaccatcccggcacacaagtttttgcacattaagaattatgaaagtaacgggtattgggatttttgggaaaagcaaagccatatcccaggccaagactgcgaaacaatctgcggcttgctcgatagtatcaagggaaaattggatgacgacggagggagcgaaaccaacagcggcagcggccagcttatggcatatatgaatgacccggacggcaggctctgcgattggggaatcccgcgtacagaatgttacggcgcgcgtcttcccgtcgattacaaaggagtagtcccgccgcaaatgcttctggttgatgttcctgaagccgagtatcttgtttttgagcacggtccctttaattatgagcaggaaaaccgcagtatagaggaaaaggtcgaaaaggcaatggcatcttttgatttcacaggcactggttactgctatgacactacccctggcagaatcatttacttttactttaatccggagcggttctggaagtatatcagaccggtgcggagtatctcaaacaagaaggtatattgaaacaacatgtattataccacctgataacagtgcaacaacagcacctataataattcctatcccggcacctataatatggtgccgcggatttctatattctttatccatatcttctgttccgggtattcttgtttttttgctgtggcagaaaagtccaatatctaaaaccagcaaatcgtaaatatttacaacaaaaaatagtatgaacacatgtatatatgcagatgtgaatgtttttgcaccggaaaaatacgcaagtaccgcaagtacaatggcaatcaaaaatataaaaattatttttattgataaatgtcttttttctattttatctataacccccttatattgcggcagactttctacccgcattctgatttcttttggataggacataatttggttgacagggtttttgtaaagtgggggaagtatcataaatgaaaagaccccacatgcgaaaatacattcaattgttaataacatagcaatcctccttttgtatgtttcacatagataaagcaacatgacacacttgtgcattggtctgtaatctagtataatacggtcagatgatccggacaagatatccggtagaagtgatacatatttttaaatatgtgccatgggtggaacaggagaagaaacatatgtactttaaagaaaataaccaaacgaaaaaacggattatagaagctttatatgagttgttagacaaaaaagactaccatgatatcacaatatccaggattgtcgataaagcagcgttaggaaggagaaccttttacagatactttaaatctaaggatgaagtgatagaatactcaacgaatttgctgatgaaggaatttgctgatattattgtactgaatcatgctgaaacacaggacagtatcatagaatcctatactgttaaaccaacaaaaaaccgcacctgtggttcacaatttcgttctattgtgagctgcaggctgcggtttcaatcatttctgatagattatctttcttatagcatataccgagagcgaaaaacacgcggcaagttcttctatagacatgccgccgcgatattgctcaacaataaccgcattgcgttttgcaagctctttccgatacccggacaactctccccacttcttatgctgatcgtcttttgcaggaatataaatatatcctgcctgcacatacttctgcagttcctcgactaaagcatccgggagaattgtatttgcattcttatatttcatacaggctccctccttgatcatgaagtcaagcagcaaagccagctgtattaacttagcgacgcgaaactactccatgcaaatgtcgctcctgattctggctttgcacagagtcctgcatcatttttcctattcttattcttacacacaatcatcaccacctaaagataacactatgctgtcagtataccatgactgtatttgttgttcaatcccccttaactctcttagccaatccaatcagaacttcaatctatggagtaaccgtgttttcagggtgtattggcctctattctacataggaatggaggtgatatctatggaacatttcgattttaaagaccttatggcttttggaatgtttattttggcgttactgacattcttttatttaatttttaatgtaatgtgacacattgtttttataatgaataaataccggataacaatttttcaattcctcattcagaaacactttccaccgggcctcgcccatgcacatgcaaaagcctctccgcattctctatgcgctccttcgagggcacttccaccccctccagaggatatgtaagccccagttctttccatttaaatacccccagcgtatggtagggaagcacctccaccttctccacattctccagtgtcccgataaatgcatccagcctacgaagatactcatcattatcacttttccccggtacaagcacatgcctgatccagaccggtttccccatctccgaaagacaggccgcaagatccagaatattccggttcgtgcatccggtcagaatctcatgctgctgttcatccatgtgtttgatatccagcaataccagatccgtatacttcatcagttcctggaatctgccgaagaaaggttcttctctggtaaatggattgccacttgtatccagagtcgtatggatcccggctgcttttgccttctgaaacagttctgtcagaaactcgatctggagaagcggctctccaccgcttacggtaataccgcccttactcgcccagtaggagcggtattttaaagcctgcccaagcagttcgtcagcggtatactgtgtccccgactgcatgttccacgtatccggattgtggcagaactggcagcgcatggcgcagccgctcataaaaataatatatctgacgccgggtccgtctacggaaccaaagctttcaagagaatggatatatcctttcagattgttctgctctgtcatcgtattcacctcaaaataaaactttctacatgatttataactgaattaatccgtaaacaaaccggcccgtaaaacggtctgccgtcaaaaaggtgctgcctgtttacatatccgcgtggcatgttctggagattacgtccatctgctgctcacgtgtcaggtcgataaacttaactgcatatccggacacgcggattgtgaagtttgcatattcctctttttccggatgttccatcgcatcgatcagcttttctctgccaaacacattgacgttcaggtggtgcgccccctgttcaaaatatccgtccagcacccgggtaagattctcaatacgctccgcctcgtcattccccagtgcaccaggattgatcgtctgagtattagagattccgtccagcgcctcttcataaggaagctttgcaacggagttcagagatgccagcagaccgtttttctccgcgccataggaaggatttgcgcccggtgcaagcggttcccccgcctttcttccgtcaggcatggagcccgtcgcttttccgtaaaccacattggatgtgattgtgaggatagaggttgtcggctctgagtttctgtatgtatggcattttttcagcttgcccatgaaggtcttaagcagccagattgcaatatcgtccgcccggtcgtcgtcatttccgtatcttgggaaatcaccctctgtctcgtaatccacagccattcccgtctcgtcacggatgactttgaccttggcatattttattgcacttaaagaatctactacatgtgagaatcctgcaattcctgttgcaaatgttcttcttacatctgtatcaatcagcgccatctccgccgcctcataataatacttatcgtgcatgtaatggatcatattcagggtgtccacgtatagttttgacagccagtccatcatcttgtcatacttatccatgacatcctcatactccagatattctgtagtaaccggcttatatgcaggagctacctgttctctggtctttacatccacaccaccgttgattgcatacagcaggcatttggcaagattcgcacgggcgccgaagaactggatttcttttcccgtctgggttgcagatacacagcagcatatggaataatcatctccccataccggtcgcatcacatcatcgttctcatactggatggagcttgtctcgatagaaatgtaagatacatagttcttaaacgcctccggaaggcgggaagaatacaacaccgtcagattcggctccggcgacggtcccatgttctccagggtgtgcagaaaacgataatcattcctggtcaccatagatctgccgtcctgccccagccctgccacttccagcgttgcccataccgggtcaccggagaacagttcgttataggaaggaaccctggcaaacttgaccatcctgaacttcatcaccatatggtcgatcagttcttgtgcctgtgcctctgtcagaattcccttttccatatccctttggatatagatgtccaggaaagtagagattcttccaacgctcatcgcggcaccgttctgcgtcttgattgccgcaagatagccgaagtacagccattgcactgcttccttcgcatcctttgccggcttggatatatcaaacccatagacagccgccatctccttcatgtctttgagcgcctttaactgatccgcaacttcttctctcagacgaaaatcggttcccttcattccgtgtctttcggtttcgttaaagtccaccattttttgttcaatcaggtggtcaattccgtaaagagctacacggcggtaatcgcccactatacgccctctgccatatgtatccggaagtcctgtgatgatcttattatggcgcgcctttttcatctccggggtatagatatcaaaaatcccctggttatgtgttttgtggtatttggtgaaaatctcatgcagcttctcactcggctgatacccgtaagtcgtacatgcctgctccgccatcttgataccgccaaaaggcataaatgctctcttaagcggcttatctgtctggagaccgactaccgtctccagttccttcatctcttcatcaatgtatcccggcccataagccgtcaggccggaaacaacctctgtctccatatccaggacgccgcccttcgcccgttcttcccgctgcagctcctgcagcctgccccagagtttatttgtagcttctgtaggtccttccagaaagctctcatcgccctcataaggagtataattgttttgaataaaatcccggacattgatgtcatctctccatagccttcccttaaatccttcccactgatcataatgagtcatattataaaatcctcctttgatataacaggttatcttttagttcccgcccagtatatcatttcgttaaataaaagacaagaggataagtgataatagttttcattattggccttgtatctaattttatacaatatatagtgttttctgctacgcttatgtgcatcagtagtgcatgacaacaggagtcccgtttgatatcatgctgtataatgtcgctgcgccgtccaacggcatattaatacatccgtgggaaccaatactccagtacaggtctcccccgaatgcgggctgccatgtggcatcatggaatccaacgccgccataagtcacctgcatccagtagtccacccatgtccggtattccggctctcctgtctccggcacaatatttcccacaagggtagtgcctggaatcatcataagaatatcatatacccctgccggtgtggagtgttcataaggcttgccggttaccacggccgtctcaaaggcaacattcccatcaacaatataccacatatattgcgcactcagatccacctcaataaatgttttgccccagtcctgctgctcatggctagccgcccgctgctcgtataccggctccttggttgtctgctcaccagctttaatactggcgatcagtgcatccgcctcagccgcctcattgatcgccgagccgtaggtaccgccgcttacttctgtcgcttttccccagggcgtggtcagcggacgggtcccgtaaagtgtttcatattttgcggcaaattgattcatatattctctgaccttgtcttcatggaaagtaacattcatgttctcatcccaggacagccatgtagaaatcaacgccttgtccaccacctctttatgcggcgccatatcgtaagtgatgcttgtcccgcagtacttgttcaaggtatcgcaggcagccgccacctcttttgaatccgcagtatgcttcggcttcagataacagtcttctttctccaggctgaatttctcttccagcccctgcactgcctgtattagcttttccttcattggctcctgatcgatttttgtccccagcacctccggctttacaacaaacttatctccatcaaactccggctttgcactctccggatcactcttctcttcattctggaaacattgcagcgcctgaatcttttcctccagctgtttgtggtcatattcaaaacccagagacagctttaccttatggtctttccaaagcatcgaaggccaaagaaacgccccctgctccttcagcgctttatccagctctttactcttcttatacttcatggatatcgatgatccgctgatctcctcactgccgccttctttcggagtaactttcagcgcatatccatcgatctgccctgcaaaataccgctcggcctcatctgccgtcttcatggaaaagtctacgccattaatcatggtattatgaaagaaatgactcatgaaataaatagatatgccacagtaaatacagatcaaaatgccagctgttatcccccctgccagtaataccttcttcttgccgctcatcttatgtaccctcctctatagtaatacagtattatcattacattaaatagacggattttcaaggcaaaaggctgcaaattttcagtattttttctaattgcttaaatatgtgaatcgttttaaaataaaatatgtgtgtaattcattttaaacatcgtaaaaccattgctcaaaccgcacatatattacatagtatgcaatatattattttcagaataaacaacatttgaaaggtagtagttaaacatggaaattagaaaagcaaggctggcagatctggaaattctgctgaaaatgtatgaaagtgcaagaatgtttatgacaagccacggaaatcccacacaatggggcagcacctatccacccaaagcactgctggctcaggatattgaggatggaaacagctatgtctgcgaagaacacggcaatatcatagctacattctattataaagagggccgtgacgatacttataccaaaatatataacggtcagtggctggatgaatccccctatggggttgtacacaggatcacatccgacggcaccatccgcggggctgcatccttctgcctgaactgggcactagagcagtgcaggaatctccgtatcgatacacacagagataacgtggtcatgcagcatatgctcgataaaaatgggtttcagtactgcgggatcatctatctggaggatgggagtgagcggatggggtatcagaaacgaatgtagggccacttggtatggggacgccgctccgtcccacggccggttggttcatccaaacggtagggaggtcctcgctctcggatggtaatgtaaatggtaacagttcagacttgtctgaattattaccgtaaacggaatctgggtgtgagaaagttttggtacgggattgactttattggggaatcagtgcataataagattgttaataaaataacatactgattgatttaggaggaattacaaatggcaaatattttgattagtccgggcaagtacctgcagggtgccaatgagatggcaagactctgtgattatgcgaaggtgtatgggaaaaaggctttgattcttattacggaatctggttataagcggatcggcaatattgttgatgggagctttgctagtcaggattttgagatcgtatatgattattttaacggtgaatgcagcaagaatgaaattcaacgtcttactgagattttgaagaaggaaaactgtgatcttgttattgggatcgggggcggaaagatactggatacggctaaagcagtggcatattatggacatacgccggttctggtgtgcccgaccatcgcatctacggacgcaccctgcagcgctctttctgtgatctacacggatgaaggcgtatttgaggaatatttattccttccggctaatccgaatatggtcttgatggatacggacattatttcaaaatcaccggtacgtttaaccgtatccggcatgggggatgcccttgccacatattttgaggcaagagcggtacagacaaaaggcgccgctacctgtgcaggaggaaaagtgacctcagcagctatggccctggcaaaattatgctttgatacattaatggaagaaggtgtaaaagcaaaacttgcgctggaagcaggagcatgcactgcagccgtagaaaaagtaatagaagccaacaccctgctgagcggaatcggctttgaaagcggcggactcgcaggagcacatgccatccacaacggcctgacagtgctggaagactgccaccagatgtaccacggcgaaaaagtagcattcgggacaattacccagctggtactcgaaaacattcccgcagaagaactccaggaaatcatcgacttctgcatcgaactgggcctgcccgtaacattaaaagaactgggaatcaaagaagtaaccgaagaaaaactcatggccgttgccaccgcagcatgcgcagaaaatgacaccctgcataacatgccgttcgaagtcaccccagaaaccgtatgcgcagcaatcaaagccgccgatgcatacggaaggtactttcttggagaagattaagaaaaacccaggatacaactagtttatctcaaaataagcaactgcctcttaagctgagataaactttcgtaagtgcagcccacacaatccgcctctcccgctcggctccacacccaagatagcctttccttccgcccggatgcgtccagcctgtcctgagaggttcacctgccgcggtgcagagaaaatggggatgcccctttttgaaagcataaaacgcgtaattagaacggcttaatggaaaccctgttggattttgagactgaaatcggctcacaaagccgatttcaaagagacctgagctgcacaatcatcaagatcgtgcagtgaatgtctctggtgtctcaaaatccaacagggtttccatttagccgttctttacaagtgatctgctttcagaaaggggcatccccattttctctgcaccgcggcaggtgaacctctcaggacaggcgtctccctccagcaagactatctcacagcatccccttatagattttttccgatgtaataggcatttcccgcactatcactcccactgcattctgaactgcatttgcgattgccgggggcggcgtattgataacgatctctcctatggattttgcaccgaacggacctgtcggctcgtaactgctctcaaactccacccggatctctcctacatccatccggcttgggatcttatactgcataaaagaattgctgtaatttttccccttttcgctgtatacgatatcctcgtaaagggccataccgatcccttgggctattccgccctccgcctggattctggccagattcggattgactacggttccacagtctacgactgcagcataatcaaccagctccagctcccctgtctctttatcgatctctacctctgccatgcccaccataaacggcggcggtgataccggtgaggtaaatgcctcactggcataaagtgcttcttcattgttgcacataacccgattgccgatatcagcccttgatatgctccttcctgttttcagatccagaacccgttccccatcgaattccacctcttccgcagaacatccaagatatgacgcccctctgatacagattttctccctaagtgtctcacaggtctttacaacagccatgcctgtcacataggtggtgctggacgcataggaaccgcagtcataaggggatacatcggtatctaccccatgcacgatgatttcttctatctcacactccaggcattcggctgccatctgggccagtatggtgtcgcatccggttcccatatctgtagccccgatcataaggctgtaaaagccatcgtcattcaccttgattcccactgatgcagtgtctacagctgagataccggagccctgcattgccattgcaactccaacgccgcggacttttccatttcccatatcgcggcatggatatttgtgatcccagtctatcatctctttcgcccgtttcaggcagcggtccagtgcacagctatttgccgtttcaccataataagcaggcattatctgtccctcttttaccatattaagttcacggattttaaccggatccatgcccagctcagccgcaagttcattgacagcagattctactgcaaaaatcccctgggtagcgccatatccccggtaagcccctgcggacatgacattcgtatagaccacgtcatacacaaagcgaaaggcttctgcctttccatacagaggaatagacttatgtccggaaagccccaccgtagtcggaccatgctctccaaaggcacccgtattcgagagagtgtagacatcaatccctttgataattccattcttatccgccccgacacggacatggacttccatctcatgccttggtgaggatgcgatgaaggactcttctctcgtataaataagcttagccggttttccggttttccaggtcaccagcgccggatagacctcggtcaccaccgtttgttttgctccgaaacctccgccgatcctcggcttaatgacacgtatttttgacttcggcacgtccagggccgtggccagaattctccgcacatgaaatggaatctgggttgaagaaagaacattgagcctcccataggtatccagatacgtgcaggttctgaaagtctccatcattgcctgctggtttgccttcgtatgataggttctgtcaattacgtattcacagtctgccagaaccctctcaatatctccctggaagtcctcctcatgggcgcacaggtttctctgattgtccgcccctacggggcagagactcttccagttctcctccggatgtacaaggataggattgtcctttgcttttctgaaatccaatacaggttccagcacttcgtatttcaccttgatcattttcatagccttgctgactgcttctttggttttgcctgctataatggcaaccgcatcgcccacgaaccggacgcgttgatccagaatcagcctgtcataaggacttggctccggataagtctgccccgccattgtaaaacgcttatccgggcagtctttgtaagttagtatacactcaatccccggtactgcagctgctctagtcagattgatgtccttgatcagtgcatgtgcatgagggcttctcagcacctttacaattaagcagtccacaggcgccagatcgtctgtgtagacgccttttccggtcacgagtgcctgcgaatcaacttttggtacggactggtttacaactctcatgagcgcacctcctcttttttccactgtaaatacttctttatcgcacgcagctgtcccatataaccggtgcatcggcacagatttcctgacaggtattctttgatttcatccgtacccggatcttccagttcacgtaccatagcaagcacgttcatgataaacccaggagaacagaatccgcactgttcggcgccttcatttgccaaaaatgttccaaactcctcggcttcttcttttaccccttccagtgttgtcacttcctgcccttcaatgcttgccgccagaatggagcacgacaggcgggattttccgtcgatccacaccgtacagagaccgcagtttgttgtctcgcagccacatttgacactgtggcatccaagttctctcagcacatccagaagaatggtatcgcctgctgcttccacacaggcctgttttccgtttaatatgaattttacttccatctatctgccctcctgtgttcggtctgccagaatggaacgcatggccctcaggatcagcacttctgccagatgatgccggtattcggcgctcccgcgcatattggttccgtaaacaaagcccgcagccgcctctttcgcgcactcggccagtttctcttctgtaatatcatccgggatttcccactctttctccagcactgccgccttcataggcctggcccccactgaaaagtaccaggtttccttcccatgcaccggtccggtaactaccgcacaggagagcacgggaaaatctgttttcgtcctgcggacggaggaataacggagcttccggtcgctcttccttatgataatagagacaaggatatccttatcccgctttttatttacaaattcggacaggcggatcgttcccccgtcatacagctctacgaatgtatccagagccagcaggcaggtcagcacatctgaaaagccgaatctcccataaatgcttccacccacggttgcctgattccggaactgtactcctactatgtggcgtacggactcagcaaccgcatctccgtacatttcccttaacccctcgtgaagctccagctgccgcagggtacacatggctccaatacggaatacatggtctgtctcctcaatctgatccagccccaggcccgatatatctataattgtctgtacctttgcatttcccagacgcatccacatcatgccgcccatgatgcgcgcatttctggcctggttcagctcataggcctcttccagtgtttttgcttttacataatgattaatcgtaagcaaaaccgttctcctttcaatccccattctctgctctgcgcgaaaaaaaggtgcaaatgcttactgtcatttacacctcgtacttaaatatattatcatattacgccgattttgtcaaaatatctgtgttagattcaacgggctttaggatcgttgacgtatggagacgcttaataaccagaaggctggggttggcatggggctgtatgtgcaggtgcgggaatgcacccgtactgcaaaattcttctaagacagcctgtcccggctccggttaagcgtccctcctttctacagctcccccccattactctcaataacccttttataccactggaatgattttttcttttttctttccagtgttccgttccccttattatccttatccacatagataaatccataccgttttttcatttccccggttgtgaaggatacacagtctatacatccccatggtgtgtaaccgattaattccacgccatcgaggagcacggctttcttcatttcattgatatgttctctcagataggatattctataatcatcatctatcgtaccatccggttttacctcatctacagcaccaaaaccattttctactatgaataatggcttctgatatctctcgtaaagcagattcagagcataccgcaggcctacgggatcaatctgccagccccagtcactcttttttacgaaggggttgctgacgcttcccggaaagccgtccagcccgtttccttctctgaccacatctgctttaaccgcattggtcatatagtagctaaagcctacatagtcaaccgtgccttcctttagtatggctgcatcttccggatccattttaatcgtaaaaccttttctctcccattctctgtagatataggagggatattccccgcgcacatggacgtctccgaacagataacggtcatgcatggcctccacagagtacatcatatcgtccgggtgacaggaatatgggtaaatcggtacacaggctaccatacatccgatctggaaatcggggttgatttcatgccctttcttaactgcaagtgcactggccaccagttcgtggtgcacaacctggtacatgcattcttcgggattctcctcctttgtgaatatcacgccggagcatgtgtaaccgaagagaggatacttataattcttctggttattgatctcattaaaagtcatccagtatttcaccttatctttatatctctccataacagtaactgcatacttcacaaaaaaatcaatgagttttcgatttttccatcccccgtatttttttacgagatggtaaggcatttcaaaatgtgataatgtcacgactggctctattttgtatttcagcaattcattaaataggtcgtcatagaattgcagtcctgcctcattcggagtttcttcatcacccaaagggaaaatcctggtccaggctatggatgtgcggaagcacttgaatcccatttcggcaaacagtttgatgtcttctttatagcgatgataaaaatccactgcctcatggttgggatagtagcagtcacgctggatatcgtctgtgattcttcggtccacaccgtgcgctcctccggtcaaaacatctacaatgctgactcctttaccgccttcgttccatccgccctctacctggtgggcagctaccgcgccgccccagagaaaatcatccggtaatctatccatttgcatgctcctttccttccacgtacataaccgtttccattgcctctacattctgatttgtccgaacatccagcttcgccacctgttccatgtctgttaagatatagattacagttggatcgtaaccctctttttgaatcagctccggatcgaattcgatcagaagatccccctttttcactctgtccccctgctccacatgggcataaaaacctttgccctccagctgaacagtatcgattccgatgtggatcaggatttctctgccctcctctgtaacaagccccaccgcatgaccggtcgggaacacggcttcggcggttccgtcaagaggggcatatatttttccttccgaaggtatgataccaagaccgtcccccattgcaccggaagcaaatgcttcatcatttacctgtgaaagcgggattgtttttccctttacgggacttcccatctcaaccccgaagccctggattctgctttctgttgttttgggagcgccgtctttatctttctgttccctatttggggaaacagacgattttgtatcatttgtttcaattgcattatcattttccggaacatcctcatcgaagccaacgatgtaagtcagtacaatggccagaacaaatgatacaacaatggaaataagaaggcctgtaaactgtgacatgtgacccgctttgaaataggctggaagtgttgcgataccaggcatgttgtatccccatgatacggcattgaaagccccggcgataccgccgccgactgcacccgccacgcatccgcagatcattggtttcttaagccgaaggttaacgccgtaaatagcaggctctgtgataccgaaaagaccagtaactgctgctgaaagtgatacccctttcatgtctttgttttttgtcttcaagaatacacccagtgcggctcctgcctgggagaatacggctgaggcctgaagcccggtaaaggtatcatatcccaggtttgcatagtttccgacggtaaccggcgtgatgccccagtgtacaccaaagataaccagcacttcccacaggccgcccacgattacccccgccacaatcgggctcaaaccatagaggtaattgtaagcccctccaatcgcgccgccgatcgtatttccgataggcccgaatgcaagcagtgtcagaggtaccataatcacgatcgttaacatcggagaaaacagatttctcactacgatcggcaggtatctgtcaaaaaacttctgtacataggaggcaatccaaatagaaagaatgatcgggataacagaggatgtgtagcttaaaagctgcaccttaatacccaggaagtaaacatcctgtcccgcatttaccatattcatgtagtccgggcttacaagtgcacaggctattacaaccgccacgaacgtgtttaccccgaattttttggatgcggtaactgcaatcagaaccggcaggaaggtaaatgccgtccatgaaataaaattcagtatctggtaggttccccccgttgtgtcaatggcatttagcgccacaagtattcccagaattccctgcaggataccgcaagctgcaagggtgtataaaaacggtgcgaagatactggatatgatgtcgataatcctgctgaaaactccgccctttttacccgtatcttttgcctgtttctcatcgatagataccagtttcagtacctcttcgtatgcatcttttacgtggttaccgatgaccacctgaaactggccgcccgcccgcaccgtggttatgacccccggaatcttagatacttttgctgcatccacaattgtttcatcttttaatataaaacggagtcttgtcgcacagtgtgctacatttgttatatttccgtcaccgccaagttcctgtaccagttccctggctgttttcccataatcaatagccatttcagctacccctttcttctcaatttcgcaccggctgctctgtagttcttattatacataactgctttcaaattcatagtatttcacgttctttagaaatttatatgcctggaagaaatttgtttcagagaaaaaacaaggtgtttcctgccaacgcctattaaagatgccagagcgccttgctcactcaatataatataaaaaggcagctatgaaagccgccttcctattgtttctatcaaatacagcaccggaacctgtgtagtgatattatattcttctttaatcttgcgctcggacacataatatgccaggggacaatccgccattttagccagtgtgcaccccgagccatttgtgatactcacaagcctgcagtgatgttccttgaatctgcctgccagcttcacaatctcctgggtctcccccgattcggacaatgcaatcaccacggtgtcctttaagtcctcccgtacaggataatagggatcttcgatatactggctgtactttcccagatttgaaaaataccgggcaccgtattttcccaatatacctgatgtcccgatcccgataaaaaccagctgccctgcatcctgaatcacctgaaccgccttggaaatacgttcctcatattccgtagatgtaaccgtatggaaaaaattaatcacttcatctatattatcatcataagtcagctttcttttgttctctttttcttctttaaggaacattttaaactgcacacggaattccgaataaccatcacatccagctttcttacaaaaccgtatcaccgtggatgtcgaaacatgcacagcctgtgacagttcccggatcgtcatatattgtacctcttccttgtgctccatgatgtagctgtaaacaagcatttccaaatcattcaacgattgcagaacttcgtaactaaacatgcttcacctcactgatgtatcatgaatttattatatcaatgcagtacctgtgcgtcaataacttcagcgcggctcaaaggggtcagacccctgtgcagaggggtctgacccctttgaactactcgtcacaatttagtgtcttttgtacgtattttctttccatatcatgtcttgtcttccgtgtttcaacactgtcaaatatgatagaaaaatcgtaatcttccggatataactggtctgcaggaacgtgcagccgtattctcttatggttgatccatatttttttatccggcatctgtacacggagtacccccttttcattcgcagtctggcagacgattcctatttttttatccggcatgaccatcacgctgtcacccagctggtattttactgcattctcctgcatgactacttttttctttttctgtatctttgaatgagaatttctttttagttcctggttgtccgtctctgtctgaaagtccagctctgcctcctctccgtaggcagcttgtgctgcggttcggagcatattgcccggcatccccagtttacctgcaatatagaaggcgcagctctctcctgcttttccgatgactaactgatataacggacgcaggctttctttgtcaaaggtcattcttgcattcacgattccctcttcccgtttggcatactctttcacttccggataatgtgtggtgaccagaaacagtgccccgctctttttcagttcctccagaatggcgatggcgattcccatcccctctgccggatctgtgccggaacccagttcgtccatgataaccaggctttcgcggctgactgtttttagtatgcccaatacatttgtaatatgtgcggaaaatgtggacaggttttcagacaaattctgtccatccccgatatcacataataccgcattattcatgcatatttctgcatgatcacatgccacatgcattccgcactgtgccatcatgcaattgagcgctacagtcttgattgccactgtctttcctccggtattggggccggtaatgaccacaccgttaataccgttccctatttcaaagttcaaaggcacattgatttttctgtccatcagcggatgccttccgttcttcagcttgatatagcgttccgtattgatttccggctgcgtccctccgtattccaggctcagctttgctttggcgaaaataaaatccagcttttcaactgtcctgttgtttttctttataatctcttccttatcggacagcagccccgacaatgtgtacagaatcctgatcacctcattttcctcatcaattctgagttcctgcagttcatcgtagagcgcggcaactgcagctggttccacaaataaggtgcttcctgtagcggatttgtcaatcactgcgccggcaatcttaaatcggtattctttcttgaccggtatacacagatgtccattttttactgtgctgaaactatcagacatataggatttgtttgcccgcagtgctgcatctgccttctggtgcattttatcgtctgtccggtcaattgcctccctgagcgactttaaggtcttagaggcatagtcgtctacttctccatttcgtatcttttgattcaattcttcacagacctcatccaatgagtccagattttcttcataataggccaggctcagttcatactgctttcctctctcaagataggacttcagccttcttacagatgtaagagtcctggaaatacattccagctgttcggcagtaaggcatcctcctttgcccgcaaactcgatccattccctaattccctgaagcgccgtcatcggcggcatcccgcatttttcaatcatatacctggcttctgtagtctccttttgcctggctctgacatcaatttcggacagatatggtttcagatcccttgcctgcccttttgccccctccgtgcatgccaaatctgccagctgttcttttattttatcaaattctagtattttttctgtgtctaacatattgacctcctgaaaaataaccgaccggttattttgtcctaaattttaaccttattcacccgtttacatcggattcgcccggaggaccgcataatacggtaccctgcgggtatactcatttcaacaaaaaaacgccacgaaaagtatctgcccatatacaggcatactacttccgtggcttgtaaaatatactataacagaaaaaacagcatgaccatacagccatgctcttcaaatctcatctatcacagatatctatccgaagcgtatgttcgcattttgtaaggcagataaaaggatacagctgtcccctaaaaacgacaatgctgcttccccacaactatttaattagctgtattctccattactaccacacgtaacatacatttacctctcccgaaaaattttctttattatatcccggacctgtgcagattgtcaataagaattttttacttatacaatctttattaatggcagccgtaaagttttgtattttattttatctcctggcatttcattttgttcatctttctaaagagaacccacaccgaattggaaaaggcattctgccttccaaagcgatgtggtttttataagtattacccaatatatctgcctaaaaacagcttaataatctcttcgtttttttcctaaccgcacattctccatttcattgactaattcctctgacatgtggtcgaataaataatttcttgcattttccggtttgttcaggtactcacttcggatctcattctgcataagctctatttcctctttcaatccgtcagcagacatccgctgcgctccctgcccgaggataatcacctgctccagggcatcggatgtagcaaccgtaacatcatacccccgtccgatgcggcgtaccgtcttttctatatactggtccgcagtctccgcctccttggtataaacgacgtaaatgttgtggtatttcagaacctcccccggatttccctccaccttgtaggcgtcaaataccagaatcagcgtacactgcttatatccctggtaattgcacagaatatccatcagcttgtcccttgcactctctatatttacctcagccagagcgcttaaatcttcccatgcaaatataatattgtagccgtcaacaagcagataggtctctctgcttttcttatttttctgccgctcctcccattttccgtcggttagcttcttttccggtgccttaacggtaaccggcgcactctgtgtccttcttttcaccggatccggagtcctcctgtagatcgcatccagttccgcctgtgtcagctctatcctggaagaagagccggaagccggcggtatatatacaaataaatcctgttcgggagcgtctgtcttcagagtgctttccatatgcatatactcctccacctgatcccatttcacaacaaatccagcaccatgggcacagaaaaccgatcctgtcggattctccatatcggcctcagaatcataaccagctgcggctataaccgcctcctgatcatggcacggctcatatcccctcaggctgcagaacatccggccctgcccgcccgtgtaggaaataaattcccgctgatatccccgcatcgtcgctaccggaacgattccggtaagcaccgcggtccccccgtccatcccggggtgatcgaagcggccgtacatcttttgtatatcagacatcgcgcgtccaatatggtccgaaggcatttccaagcggaattcataatacggttccagcaaaatgcttttcgcttttttgagaccctggcgcaccgcacggtacgtggcctgtctgaaatctccgccttccgtatgcttcagatgtgcccgccctgctgtaagcgtaagcttcatatccgtgacagccgcgccggtcaaaactcccttatgctctttttcctccaaatgagttaagatcagccgctgccagtttctgtccagaacatcctcactgcaggcagacgtaaactgaaggcctgatccccgttctcccggctccaaaagcaggtgtacttccgcataatgccgaagcggttcaaaatgcccgaccccctccaccggctcttcaatcgtttctttataaacaatattcccttcgccaaattctacacggaccttaaagcgctcccatatcaaacttttcagcacctctgtctgcacctctcccatcagctgggcatggatctctccaatctgctcctcccacacgatatgaagctgaggctcctcttcctccaactgcttaagattcagcagcatctgatgcacatcgcagtccacaggaagctgaatctggtaggttagaaccggttctagtataaacatgtccagctccttctccgcgccgattccctgccccggatacgtactgacgggacctgtcacagcacatacacggcccgctgcagccgactggacagcctcatactttgcacccgaataaatacggatctgatttatcttctcttttgtgccaggcagtatattcttcacatgcagagtccctcctgtcaccttcagataggtcagccggtttccttgttcatccctcgctatcttgtaaacctttgccccgaattcacggggataatccgggctggccatgtacgtcctgagcccctccagcaattcttccacgccttccagtctgagtgcggatccaaagtaacaagggaatacctttctttcacggaccgcgcgtaccactgaatccagcccaatcttcccggtctccaggtattcctccagcatgccttcctcacacactgccagattctccagacagctgtcctccgcattttccaggttagataattcataaaagcccacacacccgtcactcaggcgtttctttagttcttttaaaattaactcctgatccgttccctcctgatccatcttgtttataaataaaaataccggaatttgatactgtttcagaagacgccagagggtaactgtatgcccctgtacgccgtccgccccgctgatcacaagcacggcataatccatcacttgcagagcacgctccatttccgccgagaaatccacatggcccggtgtatccaaaagcgtgatctccatatctttccacacaaattccgcctgttttgagaagatggtaatccctctcgaacgctccaggtcaaatgtgtctaaaaaagcgtcctgatgatccacccgccccagctttcggatactgcctgccgtatagagcatgctttccgacagcgttgtttttcctgcatcgacatgagcaaggatgcctaggcagatatgtttatgggggttattcgctgatgtattgctcatcaaaaatacctctttctgttctataataatcaaacattatcataacacaggaagaggtataagtcgatgctcgtttctatctgcttctttatgcagttataccctttgtatgctggtatcttctggcataagtattcttcccccgtatcaactgcatctgatgcaactcgcagatcctctgcttttttcatccgctttactgacaattggatcttccacatgttccctcacgtcaagctctataaccagcaccggataccggtctttcccgtgctttatcctgaatggtgaagcggttctgcaaaacccagatattatcttacgttcgtcatttatgataatcccgcgctccagcaattccttcctgttctgcagaaccgttggcatacccaggccaagcgtagacgcaatctccagctttgatgcgctgcttcggtggaggtcaaaatgaaaatagatgaatcaatatcttttttggaaggtactacaaaaactttcattataaaaaagatacagtacctaatcagccgaatacctgatttggaatatattatactgtttggcagctatgcacgtacagaacagaccataaaaagcgagattgatttaatggcaattacatcaagcattcccgaccgcttactccgaggtgatttatgcagtgaatttgatgaagagaatatagatttagttttttatgatattgaaacatttcgaaactcaagatgccttttagtatctcaggtcaaaaagaagagaatcgtattatggaaaaatcccccccttttggagaagaaacatatcaaaatgcagcaaaaaagagacaaatccaagagctggactcttttgatctgtaattatagatacaaaacatcacagccaaggcatacatatccctggctgtgttcctgcttttgaggtgctcttcctgaatctgcataagcggtgatctccttctttctcagcgtctcttctgtgaaacaatacccgcttatatatctcagcgtccgcccaactctctcccataccgcccagtcctgtacacggtcagtccaacctctatggcggatgcaattacgataatccccaggatgatatcagataccagtcctgcattccacctgttaatcaattcattcttccagtgaaatgattcgctttagtttaactctaattcaaatacaaaattgggattccagatgggaagtacttttaatacgagtaccgccaatattatctgaattccattcgctatgatactgctcagcatcacagtccggcagtagcacccggctacaagccggataatttcatctacaaatgcggccatcagggcaaccagaaatatgggcagtatcatcccccatctgtccatattaaagatggaaatgcatgtaacttcgtttccatctttaaagcatgctccaataaactgcggtacaaatatgagaataaaggcaaaaatcatgataaataccagggatgcaacacaatccccccggctgatcctggccttcttatccggtatcgggttcagtatgtcggaggtccagaccttatccttttttagttctacctttatcttctgccgttccataaatgcaaagaccaacgtcaccgctccaaatgcaccaacagaccccgtcattagcccgcttataaaacgcgctatctcgtagaatacatttctatagtcaatcacacactgaaccaccatggaaataaacatccctgcccatacacagatcagcacgatcttcatcacccagatataattgtcataatactcaggactgatgacataattcttatcttccctgtacttacgggcaaacacagccggatctccaagttttgcaaatacctgatcgagcgtcagctcttccagcatatccccgatcagttccctcatctccagctcaatctcgtcccgctgctcctttggaacgcgccttgtaacttcgtaaacatatcggttaatcagttctctctccctgtctgtcataacgctccctcccttaaaatccgctccatattaaacgaaagctgctcccactgtgccttcagttccctgtaaatatcatctcccatgggagtcctcctgtaatattttctcggtttagactcccccacatcccattcgctgctcaaaagtccctgcttctccagacgccggagcagaggatacagcgtgttcgggtcaatctctacccccttctcctcaaggctctggacaagagcatatccatacttggcttcccccagctggctcagcacactaagaatcagcgtacccctgcgcagctctgacgtcaggtttgccatcaaatccttctcttccggcatagtaaatcctcctttaaacaaattatactgtatgtcgcacactattgtcaagattataatagtgggcggtggaggtattgcaggggggacgcctgccgaaagagggggttctgcccgggggcgggaaacaggaaggggcctttctgcaagctgtccatttgctgagaacggctaagcggaaaccctgccggattttgagacaccgacggcattcactgcacaatcttgatgattgtgcagctcaggccgtcttgaactcggctttgtgagccgagttcagcctcaaaatccgacagggtttccgctaagccgttctagcgcgcattctatgcttgctgaaaggccccttcctgtttcccgcccccgggcagaaccccctctttcggcaggctgtgtgcatccttgtggaagattccccgtcacttgggggagtgatcggcgggagcagcggattaaattggataaaagggagtatatcgactccagtatttatttttacgcagatgcttttgtctgttggttatattgtatactttatgtgccgtcattcattacgaccaaatttttatgagcctccccacatgttcacaactgaccgtccggatttatttttccttccaataccacgcatgcagcccaacgtgatccactgctcccgtctaatattccctccgggaaagccgcacttctgtcttgatgagtctagcgctgttgatggacagtcagggagccgcattcggatatacatgctgtctgataatgctagagtggatcctacgaattctaggaagaaatcaggcgggaaacaggggcacgggatgacacagcgtgggaaaatatcaattttcccatgctgtgtcatcccgtgcccctgtttcccgcctgatttcttcctagaattcgttgacccacgggtgcattatcagacagcatgtatatccgaatgcggctccctgactgtccatcaacagcgcgccccctttaaatagtatgcgttcctccccatatcttctgtagagaatatatagacttgtttaggttaaacagatatgcaaaagcgcaaactataaaaaaatgtggaaagtatgcaaaaccaaacacctccgccccgatcagcaccggcgccagaaatgtattgctggcacttccgaagacgctggcatatcctagcgccgccgcaagttccggggggattcccatcacaggtccggctaccgctcccagacttgcgccgatggcgaacagtggagtgacctcaccgccttgaaaaccggccgtcagtgtcataattgttagcataaatttcagaatccaatcaaagctataaatttcaccgccataaaaacttatatggatcagattcgtccccagccctgcatatctcccctggtagagtaaaagcagcagcatgcttattataagtcccatatagaagatacggataaccggctggctccaaatcctggcgagtttcgcttttatatatttcagcgcccaggcaaaagcccctcccactattccaaacagaatccctgccaggatcagctttcccatatccggcagattcagattcatttccgctgtcagagcaaaggagaacttttccagcccaaggaaatgggaggtcatgctggctgtaaatgcagctgtaacagcagggagcagcgcctgatactccaatgcaccggctaccagaacctccattgcaaaaaatactgccgcaagcggtgtctgaaacagtccggcaaacccggcggccatccctgttaccaaaaaaatatgggaactgtttttcagtggaattttcttgcctgcccaatgggaaaaagttgccccaatctgtactgccaccccttctctccctgcactgccgccaaacaaatgggtaatccaggtgccggaaatgataaacggtatcagccttatcggaatcacttcctcctccccgtggccgacttcaaaaatcagattcattcccttactgcttttccccccgaatttgagatagcagaatgcaataaatacaccggacagggccagaaaaggaatcaactgcatcggatgtgcatccctaaaatcagtgatccccagcagaatcctcccaaataccgcatcgatacttcccactaccagcccgatcggaattcccaacaggcccaaaatcaccaattctttataagtcataaatgttctttttattctgtcgtacatattttctccatcctttactccaattttcttctccaacacccatcccacaatacgggataattacagcctggctgccagaatatctccgctcctataacaaataagaagtaagaatttccaacaaaaaaagctgacacccctgtttttacacagaagtcatcagctaaaaagcgtttttggaatcatccacgggagaacttcattccctcaaagtttacttttagagcatatcatttatataccctcttgtcaatatacttgcctgttatttatttccacttaagaaccgctttgtaacgttcaaacaggtctgcgcatttactgcacagaccgtacgaaaacatggtggttgcaggtatacagcccttcgctgcagacgaatttaaatgagctgaatacgtaacagttcaggcctgtttgaactgttacaccgctttaattctacaattaacaaaatatataaggaatatacatgaaaaatcagttgacattttccgctcttttgttctaaaatatacttgctcatcggagggcggatactcaacatagattatttgccggataagatggcggactgaaatgtctgctctcttatcctttttttatttatcagggtaatcctttgattttaccagttaaataaaacattacattagaaaaatataaaggggatgaatgagatgaataatacttcaaaattgacacaggggaagatattggttcccctgatgaaatttactctgccaattatggcggctttgatactacagacattatatggggccgttgacctgcttgttgtcgggcagttcgctacgcccgcggcagtatcggctgtggctacgggcagccagatactttatacactgaccgtggttattaccggcctttctatgggagttacgattattatcggacagcaatttgggcagcataaggaaaatgaaatcggcaatactgtgggagccggaatctgcctttttgcggcattttcactgattcttactgctgttatgcttctggctgcgccagctctggtccgccttctccaggctccgccggaggcctttaactttaccgtacagtatgtccgagtctgctccggagggattttgtttatcgccgcctataatactctgggcagtatcttccggggaatgggggattcccgcacaccgctcatggctgtcgcaatcgcctgcggtgccaatattgctctggacctgctctttgtagccggaatgaacatgggtgcggccggagccgcagctgccacggtagcggcacaggcaatcagtgtgctgctgtctatgcttattatccgaaaacgggggctgattttcccgttttcgagcaaacagatccggtttcaaaaaaaagttatactcaggatctgtaaaatgggcgctccctgtgcactgcaggatctgcttgtcagcatctcgtttctggcaattacggccatcgtcaaccaattaggagttatctcatcggcgggtgtaggcgttgcggagaaactctgcggtttcatcctgctggttccctcgtcctatacccagtccatgtccgcatatgttgcgcagaacatcggtgctggtcagccgcaacgggcaaggaaggggatgtattatgggatggctacctctttctgccttggactgatcatgagctattttgccttctttcacggagccgccctgtcacgcatttttgcaaaggacactgctgttatcctggcctcagcacaatacctgaaagggtacgcgattgacaccctgctggtttcctttctgttctgtttcatcgggtattttaatgggtgcggctgtaccacctttgttatgatccagggcctagtcggagcattcggggtgcggatacccgtgtcctggctggcaagccaatcggcagaagtgtcgctgtttcatatagcactggcaacccccttttccaccgtagtccagatcatcctctgcttctggttctttaaatggggctgctcacggtttcaaaaaaaagcagtattttcttaaaaaaatactggagtttcctgacgaaatttgttacaatatcagaggtgtgccaggtaaatgacacaccccatacgcagcagtggtcgagttggctgatggcatctgcctcgaaagcagaagagcggcaacgctccgggggttcaaatccctcctgctgcgttttcttatttcatatcaagtcttttttctccgcactgcagaccgataagaatgcaaatcccagcgacacaacgatcagaaccgcaggaagcactgtactgtccgccatcgtataatcacccacattagcctgtgtaaggaatatgagtaaaaatgaagttacaatagccgctttggatgatttcattgccaggccgataaacagcgcaataaagctcatgcttacaatgactgcagatttgaccagcagctgaacataaaatgtcacacttcctatattatagtccagtaaaaacgatgtttccctgaaatgcgcccccacggctgcgcacaggtagatcacaagcttggttagtgtcagcgctgcaaaattaaaaatccacacggcaagcatctgtgaagccagtattttctgccttttaatcggataagtgaacatcaggttcatcgtcttattcttatatgcgctgacaataaaagaggacagcattacacttgtaaatatcagaaatgccatgcttgtaaacagttcaacgggcgcagacaatacattatttcccggcgccgcatccagctttcctgtatccgggtcgttggcaattcctaggaacgcaagagctaaaataaacactgtcagtaaaaaagcaagtatcaccgcgtttcttacgtatttactgatattatttttccgatactccagtttgactaattttaacaaatccatattatcttcccccctcagtcactttcaggaaataatcttccagagattccgactgcctgccgatagcttctacttcaactccgcccagagccagcgcctttgacagttccccggtcgaggctgtcggctcataaactcggattttttgctcatccaataccttaaagttttgcagttttatactgtctgctagaatataagcggccctttttacattctttacggatatttcgatataggcaagattcttctctgctatgtctttcatcgaaacttcccgctgcattcttccacggctgatcacccccaccgtgtctgctatatgttcgatttcagggagcaaatggctggaaattaatatagtggtattgtactcctctttcagcatccgcagcaactctcttatctgcttcatgccggcaggatccaacccgtttgtcggctcatccagtacaagcagttccggtccggctaagatggcacgggcgatcccaagacgctgcttcattcccagtgaatattcttttaccggttttttagctgcatccgtaagatccagcattttcagagagttttccacactccccttttgataaaagcccatgtattcacaatgcagcttcaggttatcctccccgctcaggctttcatagaaaaccggaaattcgatgatacttcccatacgctttaaaactccataagaattatttcggagctgctctcccaggacttccacagttcctttggttggcttccaaagatttgttatcattttcatgaccgtcgtttttccggcgccgttgggtccgagaaacccatatatctcccctttctttacgtgaaggttgatatcagtaaccagctgtctgcctccaatggattttgtaagattattggtctgaattatatatggcataagtatgcctcctttcataaatccattgtagcagcttatattttcaaatccctttctcaattcttacgaatttctttctggcctggttttaaaatcgtttcagctttacagtaaatgtagtttcagcaaaaggctcgctctgtaatatgatatctccgcccatctgtttagccaggttccttgcaatcgtcaaccccagcccgttgccctggattctgcggctgcgtgaatcttccattgtaaacagacggtcgaacacactgtcggcaaatactttatcaatgccttttccccgatctctcacatcgatatatacccactcctgctcatatcgtatggagaggccgatataatttccgtctccgccgtaccggacggcattggaaacaagattacataggattctatgcagcgcctctctatctcccagaacatagaccgctttctccggcacattgatatccacttcgaatcccttttggctgagaatctcataaaaatcaagaatactctccctgcagacctcattgaccggaatctggactgcctccagttctgtatccccggcctccagcttagccagcgtaaaaaactggttcatcatttccaatacctggccggccttatcctccactttcttcagcatctcctcatctggactgtccatgcgcatgatctccagatatcccaaaatcactgtcagcggagtcttgatatcatgggaaatattggacagcatcttcctggaagcattctcctgacaccggtaatcggccttcagcgttctccggtcttccagaagacggttaatcagatccgcaagttctgccagcaccttatcatccgtaaatatcataaccttctcgtcgctgccgtctgccattatacgagtcagatcctggttcagctctttcagtttcttctgtgtataattcatctgttttcccccagtttatacccaatcccccacacagtcagaatatacccgggctcccggggattgtcctcgattttattgcgcagacggctgatatgaacattgaccgcgttctcatccccatagtatgtatcctgccagacctgggaataaagctgttctttcgtataagctcttttcgggttcttcatcagcagcttgagtatttcaaattccttggccgtgagttccaccttctgcccactttttgtaaccgtgtaggttccggtatccagcgtcagaccgccgcataccagaacttcacctgctttttcctcttctccggtcctgtctttcccggccgatactgcatactgggtgcttctgcgaatgttcgctttaatacgcgccagcacctcggctacggaaaaaggctttgttatgtagtcatccgctccaagccccagcccaagtgtcttgtccgaatccgtgtctttcgcagatatgatgatgatgggcaccgtactgctggcccgtatccttctcatcacttccataccactgattctggggatcatcaggtccagaagtatgagatcaaaagcccccttttcaaatctattcacagcttcctctccatcggctacggcagtcacgtcataattttctgtgctcagaaaattttccagcatagcgctgatttcattatcatcttccaccaaaagaatcttcattgttctcccttccagccctgatgtttcctgcggctttacatatttcaaaacctcttatgcatcatatagaaacacacagccttaacttattatattccctctaaatatcccgatcaaatcctccagggaacgcttgcctcgctgcggcctgcagtagttgccatgattgccaaagccggaattaccacatcataaaacaacagggatgtacagcatgggggtacttttgctgtacatccctgtattgaattatcctctcgcaaactgctgcagcaaccccggaatcttgctttttaatataacgatattcatactttgcggattcatcacgatgccttctacattcttaccgagcaccttctctatattggcaaattcgatcatattggcctggaattttccctgtgtattgaatttcacaaactcattataatctgtgaaaatcggctggaacatcttaccctcctgattcttcacacagggaatcttaatattggagccatccggcagcctcttttcgccctctacctctaccgcaatcaaaaatctggatctcaccagatttaccgccatctcttcttccaattcacgcagtttcggcttctcattattcgggatgcctctctggacttcctgcataaaatagagcccggtcagctgcatctgcggattcaatagcggctgttgattcttgggaagcttggaataatccttctgtaccacgagctgttccagagggatcttggatatctgcgcctcctccgcgaatacgatctcattaacgcccagaaggtacaggctgctgtagaatcccaggagctgcttgttctccagtttgacaaccatcatgaagtccttattctcatccttgcgcttctgcgcaaaatcctttgctccatcctcagtggtaaacacccagatctgatcattaaaagactcttcatcacagatcagaaaaggcatcttcgtgccttgtccaaaaatcacatatgtagtttctaacttctgcagcttcttaacttgtatttgaaattcgttttccatgtcagacctcgattcatccgttttctaaaattatactacacgataatccacaaggcaatcgaaaagtatgagtgaatgaagtgcataatactttgctgagaagggcgaaacgaatagacgctgtccaaaacagaaacagaattcatacaggaagtgttgagtcttcctgtatgaaccctgcttaaattaagtgcctcggcttcccttactccgctatcctcagttgttccactacacttcctttatagaaaatccgcattgccccccgcggtataagcacagatatcacaaccagtatcatgctcagaattattgccggaaggatcgtaatgcgatatgagaaggaccacatggaaggattggacagaatcatttttaaaagagtctgatcaaccgctactgagaacacgattcccagaaccgctgctcctgccgcataaaggcagccttccagcatgagcagttttctcagctgttttttcgtcattccgatactctgcattgtagcaaattctctccgccttgccagaatactggtgctcatcatgttaatcagattcagaattcctgtgatcccaaagatgaatgcaatgattccgccgaccatatagatcatggtttttgaagattctgcacttgccctggccttatcagccgacaggtaggtgagggacggattctcctgtatataggattccaggaactgtctcatctcgtctttactcccctcttctacatcgaaagtatacttcataacagccggttcccgataaagctctttcacttcttcctgcgggagatacagacaaggcgcatcaattcccacatcaatcgaactgcttacactgtatccaaacccttcatcatcacttgtaagggctgcctttgcgatcacagtatagctctttatttcttccccgtttatacgggcagttatggtatcccctacgttcatataattatagtattcttccaacacctttgtttttctgtcagcctgcattcccagaatgacacttccgccctccatcagcttttcataaagcttatcaaaatctttttccccctccgcaatctgcagatgtgcaagcccggccttttccattccatatacattgcagatcggataatcatctgcgcccaccgagacaaagcggccatccggatccaggccggccctctgctctgttccctgctcatcgaatacttcaatatccgagattttcatgccgtaatcataagttacctgcaggtcttccaaagtatttttatatacaacgcttgcccccgtcacgcctggcatttcctttactgcctggacagcctcagcgggaactgcctgatcacgacggataaatccttttaaattgctgcttgtatctacatgggcaatctcaaagtctgtacgtatcatctcattcacctgacgctctacgtccacacttcctgctgccgtacccaccgtattcaacatcactacactgagcatcaacgagacaacgatgaatgcggaacgtcttttatttcttccaagattcgcaaatgccatctgtccgagattgattcctctggaatgtcttttcaccctggcatttttccgttttttcccttttgtctccacataccggaatgcttccatgggagagatattggatgccattcttgcaggctttctcgtgctgatgaatacagtcagcacggccaggaacgccgctgcgataaagattaccggattcggggaaaccgaaatcacaatgttcttatactccgttgaaaggatatccataatttggggaagtgttacttttcccacaaagaatccgatcagcaggcccagcgggattcccatgcaggacacccatgccgcctgcctgttgatcagctgttttacctgtttttttgacataccgatggtccggtacaggccataccgccttacttcctgcatgacagcaatatcaaaaacattatagatcagcagatacccgcaaaagataaacaaaaccaccagtactgcgaaagcagcactcattttggtgtccatccccggattcgtttcctggttgatcaccgccgggatactgtttggggcgccgatttccctggatccgcctatggattctacgaactcatccagctgttcttccatattcgttctatccgccatcataaaatcggcccaatatgtccctgccagttccgcatcttcccggtaagtataagcaaaaatctccggatgctcctgcttgaatgcctctgacacagtcatgatactcagttcgtcatgggaactttcataccatcccgatacaaccataggaagctgataatcccttctgtgtacggtgaattcaatgaccacctctgctcccacttccggttttacccccagttcctccaaagctctatcggatgccacaatttcattggctttcacaggttcttccccgtgagtcggctggcagaaggtcaattcccgttgtacggaattttccagatccagctctatctcatgtctcactgtatttgtaagaaagcctatcggcatacgaagtcctaattcactggcaatcccgctttctttcagtttttcatactgttcctctgtcagattccggatatccgcatccgccttgctcattttcataatctgctgggtcatctgcatggactccatcgttcccaatgcaatcgtggtaacggaagtaaacaaaacggccgttagtgcaatcgccagcactgccaccagattgcggaaacggcttgccaagaaacttctttttgacagcgtcttcatgatcttcaaattgtcattttcaaaaggtaataccatctctcatgccctcctatgctgtgattctgccgtcttcgatccttataatccggtctgccatctgggccagctggtcattgtgggtgatcatgacaattgtctggttcagctcataacaggttcgttttaacagcccgattacatcggcgcttgttctgctgtccaggttcccggtcggctcatcggccagtacaatggccggttttgataccagggcgcgcgcaatcgccactctctgctgctgcccgcccgagagactgccgggcatgtattcgagtctgtcttttaggctcaaaagtcctgccacttcctccacgtagcgtgcattcacccggttcccgtccaattccaccggcataataatattttcataagcgtttagaatcggaatgagattatagttctggaaaataaatccgatatttcttcttcggaagaccgtaagctgttcatcgttcattttagacagctcttttcctctcaccaccacgctgccggatgtcggtacatccaggccgcccatcatattcaaaagcgtagatttcccgcttccgcttgttccgacaattgccgcgaattcaccctcttccacacaaagatccactccatccagcgcctttgtaatatttggctcctccccataatatttttttaatccagtcacctgtaatatgttcattttgttttcctcctctgacttactaaagcctattataattggcaattgtccgggaatcctcctggctctatgtataattttgattaattttacagaaaaagtcccggtttcgggacttttcatatcaaacaaagccgcttgaacttttgaggctcaaacgacttgatgctacaatttttattaaattgcaatacttgctgctgttataaaatatgttacttccacctcttgttgagtcaaattgtatattaatcgaattacaccttttcaactatcaataatttttattattctatgctttttattcttcattcatttggtaaaaatacagaaaaaactgaaccgttcccctgccgtgagctaaccttcacatagcctccctgaagggaaatgatctcccgcgtcagatacagtccgatccctacgccctcctcgtcatgcacctcttcctccctgtaaaagcgctggaaaatcagggcatactgttcttccgggatcccctttccggtgtctgcaatgtcaatcttcacataggcctcccagcgttccaccgatacactgatcatcccccccggaggcgtatacttcaccgcattgtcaagaatattaaagatggcttccgtcgtccatttccggtcgtgggacaccagaaatgtctccgggcagtccacccgcacatccatctgcttctgtgccgcctttgtaaatatgcctcccacagcctctgccagcgtatcgtacagattctgtgttttcttcgtaagcataataactccggtttccagccgcgacgtctttaccatggcctgcacaagaaaatccagcttgtcaatctgagaagctaaagcttcgagaaattcgtttctctcgctttccgtaaggctgccgtcatgcagggtctcctggatcatcttcaggtttgtaacaggagtcctcgtctggtgtgaaatatccgatactagggactgaagctcctccctggccctgacattctgctccttctgcttttgcatgaccttgtagagctgcctgagcctgtgtacaatcctggctaaaagtgtctcctcctccatataaggtttttcctgcaggttgtcctccgccatttcttctaaagtgacacagatctctgctgtaaacgcagataatttcttctgaaaaacagcggttagagcaattccccagcagacagtggcggctgccgcggctgctgagccaaacaaggcggtgcggctcccggtcagagcataaaccgcagtcaggatcactacatctgtcaatatcaccccacagctgatataacggacaattctgccaagggacaggctgtgataattcatcttgcttcaccgcccttccacatataacccattccgtatatcgtctgaatataggtatgttctttattctcaatcttctttctcagcgcactcaatgtggttgtcagtgtatggtcatccacaaagttgccatctatatcccacagcctgtccagcaggatctgtctggtaagaacctgcttcccgctcttggcaaaaattttcagcagcttccattcttttggtgtaagagccacaggcacctgtcctgccgtgcaggtgttctctgtgaaatcaattgccagatacccgtcatcgaacacatccgatacctgctttttctctatgcggctcagaatcgcagccactttcttctgaaatactgccacggaaaagggttttgtcacataatcgtctgctccgcattcgtagcccttgagcatatcgctctccatatcctgcgccgttacaaatatcacggctgcatcctgcttttcttttatggcccggcacacctcgtacccgttcccgtccggcaggttcacatccagcacaaccagtgcaaattggtgttccacggcaattgcctttgcatccgccgcattcataaccgattccacctcatatcctgcacttttcaggttataactcagggtcatatttaaaatcctgtcgtcttccacgaccaatattctctccattttaacgctgctccttcatatctctattctattcaccgtcaagctgtttcttattatacatgttttcgtaccataacaaaagcggaagatccctctctgttctagaaagattcctccgcttttttgatttttaattttataatcattcaaatcatatcaaactgttatctcgcccgccaatatcttcttataatcttcgtagttctttctcaaaagattcggcgtgtccaactcgtaggggcattttttcctgcactgcccgcactgcatacacccctctatttttttcatcttttcctgccattcctcactcagccaccctgccgaaggagcacgccttaccataagcgacatccttgcacaattattgatgacaataccagccggacatggcatacaatagccgcatccgcggcagaaatctccgttcagttcttttttctccttctcaataaacgccgccagctcttcatccagcacaggggcctcttccatatatcccagccattcctccagctcttccatccgctggacgccccagatcggaagcacatgatcaaactgtgacataaacgcagaagcagcgcgggagttcgtaagcagaccacctgccagccctttcatcgcaataaaacccatattgttttccctgcacagctccaccagttccagctctttttctgcggacagatagctaagcggatactgcagcgtctcataaagcccggattcaatacactcctttgcaacatccattttgtgcgcagtcactccgatatgacggatctttccctgctccttagccttttgcatacactcatacattcctgtgccatcgccgggacggtaacaaacatccacgcagtggaactggtaaatatctatgtaatcggtctgcagctgctttaaagaaagatccagctgcttctctacctcttccggcgtgcgcgccattgtcttgcttgctatgtaaatttccccgcgaataccggcaaaagcgttccccagcttttcctcactgtcgctgtatgcgcgtgccgtgtcaaaaaatgtcataccgccttcaaaagccctcctgagaatctttaccgcattctccatgtccacccgctgaaccggcagagcgccaaatgcattttgcaaaacagtgatcccagtcgtacctaatgtaatctgtttcatcttcatagcccgttccctcctcacatcttcttcatacgtctatcatacattttttcgcataaccaaatacacacagcatagaaattaagacctgctgtcaaacaaatttgttagaaattaatttcccgtccttcctttctccactgtctgagttctgctgatgcagaaagcagcagatccgaagaagaattaagtgcagtctctaccgagtcctgtacaacccctatgataaatcccacacccactacctgcatggagatatcgtctgatatcccgaaaagggagcatgccataggtatcagtaacagagatccccccgctaccccggatgctccgcaggccgacagggcagccagtacacttagaattatggctgtagggatatccaccggaacccccatcgtgtgggcagccgccatcgtcataacagtaatcgtaatagcggccccgtccatattaatggtagcccccagggggatagagaccgagtaagtatccttgtccagccccatctcttcgcacgccgccatattcacagggatattggcggcagaactccttgtaaagaatgccgtaatggcgctgcgctttaagcatctgaaaatcagtgggtatgggttcttcctgatgcaccagtatacaagaatcggattcgtaataaaggtaatggccagcatggaccctaccaaaagaacaagaagctttccatattccgtaaaaatatttaacccactggtagaaatcgtacggaacacaaggcccagaatcccaaacggagcaagattgataatccatgtcaccaacgtagaaacagcgcctgaaatatccctgagcatgtttttcgtcgtctccgccgctccccggaatgcaagccccagcagtactgcccagaataatatccccaggtaatttgcatctgccagcgaactcaccggattggaaacaacatttaacagcagcgtttgaagtacttccgccactccgcttggaggcgcggtatccgtcaccgcctttgtcagtgtcagcgtgcacggaaaagccatgctcgcaaatactgcaatgactgccgcaagcaaggtgctgaacatataaagaataataaccgtcttaatcacgcctccatgtgattttcctgcattgcaaagcgagctcatgacaaggaaaaataccaggattggcgcaaccgcttttaatccccctacaaaaagatcccccagtattccgattgctgttacggacggaatcaaaagccccagggccgctcctatgatcagacctcccagaattcgcttaacaaggctgatctccatccatttctcaaacacttttttcatcttactgccaccttctttagaatacattaagtatagcgcaggaaaaggtatatggcaaacctaaaatcaggatttagtgacgagctttagtctcggcacggatgggcttgccgcttacagtccgcttggctggttcatccgactggtaggcaaagactcgttcctaaggtggagcccgagacgggggaggcggatggaattggctatgcgtatcatgcatcttgattaaatggattttaaggcttttatgtatgggagctttgggactgtttttgaagaaatctatttatttagtaacgattatcgtgtgtaactccatatgtttttttattaatgaaccatacaattttttaaatccagtatatttacgggtaacaaggcgatctaacacttacacttatataaacgaatcaccaattctgttccatccgttgctaccgtacgagggccccgctagctcccggactcacctcgtcattcgcgtccgccatccgtcaacgagtctaaagctcgttaactaactcccgattgactgcgccccctgctttatgttacattttctaatagaaaagctattgaaagcggggcatattcatgacttctccttataccttaaaaacaattgcacatatccaaagcgatttcccggaaaaattcggcatcccccgacagagcggtctcgtggaatccctgaaggcaaagctcatctttgaaccggactaccgcaatccggatgccctgcgcggcctggaagattactcccatatctggcttatctgggggttttccgaggccatccgtgatgaatggagtcctactgtgcgtccgccaaggcttggcggcaatcagagaatgggggtgtttgccacacgttccccattccggcccaatccggttggactgtcctgcgtccgtctggagggcatcagcaccacccctgattttggcccggttctccatatttccggagccgacctgatggatggaaccccggtctttgatattaagccctatctgccctatgcggacagccaccctgacgcacaaggcggcttcggcagccggcacgcgggctacagcctgaaggtagaatgcccgcctgcatgcctgaagcttatcccagagcaatgccagcctgcgctgatggaaatcctggcgcaggatcccaggccttcttatcaggaagatccggcgcgcatctacggaatgaagtacgctggtatgaatatacggttttatgttgaaaatgatgtgcttcatatatgtgggattgaacaattgtaaatttctattcacgcggtcatgcacaggaacgattgtaaggctgaccggaagcttcattttcgttcagtttatatttcttttcttctctgccatatactgtaccagattggcaaggacccccaggcccagcaccacggcagagatcattggcgccatgtattttcctctggttatctctgcaaaatccaatataaaaaaggttccgtaacatcccgccaggatgaccagcggcagagacagggcaatggctgatatatagtttctgcagtatctggtaacggcgaataagatcattcctgctcctgctgccatcatggctgtaaacaaaatactcatgatactcatagttcctatagaccatgggaaccatccaatgtagccgctcgaaaaggaagacgccgatgcattccaaaaatctgttacacggttaatttttgcggttatcaaataaaatacgctggatattccgatcaccgctaaagaagaaatcaggccagccgccagcttacggaggtaatagccccgccctttcctgcagcagtattgaagtgacggcatttcattttgattctcctgtaccatatagggaagaatcataaatatcactccgataattacaaaaactgaccaaaactgaagaacctcaaaattatcttccaatattacagatggaaggatcgtaaatacctcctgattccgttctaataccctctgtctctgaagaccgtccagttctttataaaaggatgttccgttttcactaccgtcctcctgcagtgcctctgtcttgtaagcatccaaaaacatatcatatacattgatttctattgtcttggtgaattcctccgacacttcggcgtcactgaaggaatcatagatttccatccataatgccgtgtcctcatcgggagtcagactttcgctccccaggttgaattcctgaaacgtatggaagccatactcctgaaacaacgcattctccgctatcatccggtcaatggcactggttcccttttcaggagcctcacttttcatcttttcatattcttccggtgatatggaaaccccatatctatctgtaatagcttctgcaatatcggcagtctgatggtagctacccggatgtatatttacatacggccttataaacagaagaaaatacagtatcccaaagcccagcagacacagcagcttcttccatgtcagtatttttcttatctccgtccttatcatatacaccctccttataaatctttcttgaaaaactgtctccgcactctgaaagctgcacatgctatcagaatgccccatagaataatcacagtggtttcataatatctcggcgaaagaaaggaggcgccatttaccatccagtgccctgctttcctggcaagatcaacgggattgtactgcagtataaaataaacgacgctccattttggaaacagagatgtcaccgtatagatacatgcacatccaaaccccagcagtataaatgccttgaaactatttcttccctttgccgaaagcgtatacccaatataagaaaaaagcaccgctgcgcagactgatattaaaaattccaggcccaggtatcccgcaatatgaagcgggaaccaactgatgaccggaaaataagaatccaacaccatcatgcttccaatgggtgtcttccacagtggacctaaaggaaacataagagctgccgccaagatcgttactccccatatgacagccgtaaaagtgagtccggcaagtaccgctgccctcctcctttgatcctggcattttcttcccattttagatgtatactcaacgtatgccgtccctgcctgtaatggttcactgacacgatgcagcataaagagaacgcctgccagaatgctttccagcgtacaagccagaggaatccatcttgaaaataattcaaaaaaacctctgcttcccgggacaaagaagtgtgcggcagcctgattccgccgattttctgccaggataccatccagctttttatattcttcctccgcatatttctttgccccgtcttccagcataaggacagaggaaaaattttctgccagatcgctgctgttcagttcattcgtcatatgcactgtgccatccattatctggcgcagagtgggaattcccacttctttcttttccccgggttccaaaactttcaggtattgttctgctgtattttcaacaaccggcagccccagatcctcccatgccttcacactcttctccacaagctccctctggccgctgaagtttatcagtatccatgcatttactgccatactgccaatgagcagcccccagaaaatcgggctgagcactacgcgcatccattctctcctcatatcttcgcctcattccttgtaagtgtataaaaacacatcttccaagccagcctcacactttttccactgcggatttccctgctccgcaatgaaccgcaccacaaaatgtcttccttcctgacgctgggaaagaatttggtactgtttttcccaaagatgcatctgttcctccctgatttctgcctcaaagactttcccatccagcatggtgcagagattttccgtagtatcattggcgtatacctgtttctccttcagcataataatatggttggcaataaactccacatccgaaacgatgtgtgtggagatcataacaatcttatccctggaaagggaacttaatatttttcggaatctcacacgttccttgggatccaggcctgccgtgggctcatctaatatcaggatctccggatttccgagtagtgcctgtgcgatccctacccgctgtatcattccaccggaaaatttcttcattttcctttttgatacctctgcaagccccaccgtatccagcagatgaggaatctcccgctgcagtattttccggtcaatccctttcaaaataccgatatactccagatagcgctcaggtgtatagtccctgtaatagccaaatttctgcggcaggaaaccgatcttttcccggtatgcttcatccagcttctgtatctccctgccctcccacaggatcgccccctctgtaggaaaaagaagggtaaccagcagtttcatcagcgtggtcttgccggccccgttcggcgccagaaggccatatattccaggatgcagctccagattaatatcttttagcgcagtaaagttttgatatttttttgtaacatgattaacttgcagcatctgcatactcctttctgaacggctgtcctgtcattaccaacagctgcctgacgtgaaccactgccgcaacagcaccaacaacagcaaacaaaagcaccggaatcccttccatcagcctttcgtaccacgcagccgacatctgaaagaatacaagattggccagaatccagccggctcccgctgctgccccccatccggttttcttcccccgttctatccccatggccaggagaagggaaaaaatcatcagggatgcaaaagccgttgccgccagccggagaaaatcagccgaataccgcactgagaggactgccgcataaataaggttaaggccaataccgatcaggctgtttgaaaacatacgcgctgtcatcaggtgtaaaaaggtatacttgtaactcataagctgttcatacgtctgattctgccgctctttcaccaatgacagatagaacaccgaggcatataagacaggcgccgctgtaaatacgatgctgcaggcgctggctaggccggcgcccacaatccgtaatccaatgtacatgaacgctgccgcaatgcaaaatgagacagacaggatatctcccatgcccgcgtacagctgcccaagtccaatcccctggaacagatcccacagaaatgaatttactcccttatttagcggcgttttagtgagctcctccgcaagcctcatattctgttctttttcctctgcttttttccacatggcatctaaaaattctttttccctctgtgtcatccattttccctccttttcctctgcagctttttccttgctctgtgcaatactatttttatctgcgcaatattcttttccataaccgctccaatctcctggtaggacaggccctccacacagaaaagataaagtacacgcctgtattcttccggcagttcctctatccaatgtaccagttcgcaatacgcttctttcttcaagtaaatatcctctggcgttggcggggattcccctgcactctctgccgtccccagctcctctgttacatggcgccctcttctcctcagttcatccagcgatttatgtttgactactgcaaacagataggtccgaaacgtgcaggcttggggcaggcgctccctgtgcacataaatatcggcaaaactgtcctgtacaatatccaaggcagtctgctcctctttggcatattgtatgcagaaccgtacagcatcccgataatgcctcagcaccagtacatcataggcctgtttcatattttcgtttttcaccagcccgatcagctgcccatccgtttttttctccaggtctttcagattcattacgtttttccttccggttgtaaaaatatcaaacaagattcgctttctatctattagtcgaattagatttagaaaagttacactttagatcataaaaataaaagtcctggttctataaattcaggacttttatttttattctttttacaagattgatcatcacttttatttccactcctttaggagggcctactatccttttcacttatacttatttttacagatccaatccatgtttctatggcctgggccagaatcatctgctgccgaaggacggcttttccggtttcaggaatttggggattatcttctttttctgttatgttttcttcaagataagatttcaatgtttttatgttactttctatactggtaagacaggcttcctggtcttgcagggagaggctgtccagattaactataactgcattgaaatccagaaatatgttgaccggctgggcggctatcttatgcattagattttcgaattccgcttctccggactctgtcaatgaataaacggctttttccgccatctttccttcctttaccatcgtgcctttgatatagcctttctgctccagctgtatgactttcttatagattgagggcgtgctgatctttacccatttggatatgtttcggtattctaccagtttctgaatgtcatatgcgcttaacggctccttttttaccatccctaatacaattaaatctattgttgccataaatatccttccttttcttattcgtcttgacaattactataaattatagtattatcatttttatcgctcgtttgctataatttatagtacttcattttacactttatgtcaagtggaaggagaatttattatgaaacaatataacaaaaaaatggaactgcttggaagcgcccctgtgtcaaaagcgcttttcgcactggggctgcccaccatgattggtatgatggtgaatgcgctttataatctggtggatgcctactttgtaggagggctgggaactacgcagatgggcgccattactgttgcatatccccttggccaggttgtggtgggactgggactgctctttggaaatggcgccgcttcctacctttcacggctgttagggcgcggggagaaagaagcagcagacaaaaccgcaagcactgctatatacagcagtatctttgtaggagcggcagtcattatatgcatcctcatatttctggaacccattctgcgccagataggcgcctcagacagtgtcatgccttttgcggttacttatacaagtatctacattgcttcctctatatttaatgtctttaatgtcaccatgaacaatattgtttccagtgaaggtgctgccaaagcaaccatgtgcgtactgctggcaggagccgtgatcaatgttattttagaccccgtctttatctatgttctcgatctgggcgtaggcggagcagcgaccgcaacagccgtttcgcagtttgtctctactctgatatatttactatatatattcaggaaaaaaagtgtattcagttttagtatccggaaatattgtttatcaaaagatgtgatgtcagagattttgaaaatcgggattcccacactggtattccaactgctgaccagcctttctatgaccatgatcaacgacggggcaaggacctatggtgattctgctctggccgcgatggggcctgtgacaaagattatgtctgtgggaagtctgatggtattcggttttctcaaaggtctgcagcccatcgcaggctacagttatggcgcgaaaaagtacgaccgcttaaaagaagccgtaaagacttccatcctgtgggcaactatcttctgcctgatctttggtcttgccgccgccatattttctacagcgataatttctctgtttacaaaaaatgacccggaaatgatccggatcggacaggcggccttaagagcaaacgggctttcttttgtgctcttcggtttttataccgtatactcctttctgttccttgctatgggaaaagcaaaagaaggctgcttcctcggcgcctgccggcagggcatatgctttgttcctgttatcctgatacttccaagagttctgggactgaacgggatcctctatgcgcagccggctgccgatgtaatcgctgcagccatcaccatatttatggctttgcgcctgcaaaaagaattgcaataaaatgatgttatacgatgtactagagcgtatctgaaaattgcttgttgcaagatgttgtcccagtttgtgggatatttactgccaaatacaggaggcgtagtgggctgcgttaactggatttggcagtaaatagaccgtgaagcggggcggcatattgcggcaatgaattttcagacacgctctaggatccatgggcctgtgcgtgccgaattccctgttccgtaatgatgtcgtctcccctgtactttttgagatcatcccccacaggacagacgttcatacatacaccacaaggccagtgattttcattcttaatgtctacatgatgctgcgtacaggcgattttatcataactaaagagattattttctttctcttcaaagcaatgaaccggacaagctttcagacattttttacagtgaatgcataaatccttcttcaactgcggatctgggctgactggcgcgtcggtcaacacggaaacgatacgaaggcggggaccgtattcctttgtgatcagattgtggctgtcaccaaaggtacccattcccgcatagtacgctgctacaacatgggaaaaagaagcatttgggtttttcataagcacatcaatggagtagtaacagtctctcggaaagaacaacgccctgtatcctaattctgtagtaatataattagtcagcttatatgcaatttcatccagcacccggttgctggtgtcatataattcctgatataccatggagggggtagtgaacgtcatcggggcaaacagcgggattcccagtacaattacatttttaacccagggccaggaattctgcggccaatattccggatgctggatcggttccgtttcccatttatcaacggaacaaacgctcaccagatttgcgccaagatcttttgctttgtcaacgatttgtttttttattaattcatctttcatcgtcagcttccccttcctttccattttctaatttggtacggctctccccagtataaagaatagcatacaccttctcaattcttgctggatcgctttcctcaatgttaccatcgtagtatacggctgcttcgtcgccaatctgcagatccgtggtgctgtcttttctttctacgtccaaagagaccaggatctcctgattctcagctattgtttcctcactttcgcttacctctaaccttgcgtatccgtcttttatctccagcacggttcctttgatgcttggttcatggtctattatgtagtttatgtcttttgaacaccctgatatacagatgcttagggctattgtgagcaaaccaaatcgtatttttctcataattatcctccctgaatcccagactgtttcatccttgcattatctctgccagctgaatacaaaattatatgtctattacaagtttttccttaatttgattttatcactgcgagatataaaagtcattccttttcttctgtattaagaatacttattataatagtccgtacgattcacacctcacctaaactctaaatcgggatttagcgacgagctttagcctcggcgcggatgggggcgctccataaagggatagccgaaaacctcccggagaacatccatgtcctttcaaaaacgcggccgcggacctaagaaattctaggcgggaaacagcccggaaaatggagcaccactgacacatcacgagaaatccgatgatttctcgcgctgggtcatctgatttttggattcggaatccaaaaatctctccattttccgggctgtttcccaccaagaatttctaaggtccgctttgagcgtttttgaaaggacatggatgttctccgggaggctttcagctatcccttcatggagctggcgcatccaaccggcagaaaaaagctcgtttctaaggagaggcctcaagcgggggcagcgtatggtattgaattggcgggacttttatgcccccagtaggtgtacataagcaatgggatacggttccagtatcaaaataattcaatacacatcttgaagatgaaaagatacgcatagccaatccacatccgctgccctggtccgggaccctacccggttggcgagctttcctgccgattggatgagccagctttatgacagggaggccggggaggtgctggggctgtatatgccgttgcgatatgctggagtgcgcttagtgattcttgaacagccgatgccggataggcggggaaaaacttgatctccaaatcaagtttttgctgaacccagcgcgggaaatcatcagatttcccgtgatgtgttcagcgtacccgcctatccggcatcgggtgttctagaatcacttagcagcacgggtgcatatcgcaacggcatatacagccccagtgcctccccggcctccctgtcatgaagcgtccccgtccgtcgactaggctaaagctagccgactaaatcccgatttaaatgtagagtccagccagaaaagtaactgattttccattttctcatttacaatatgcctgcaagcctttataattaggacgagtttttatataatagcatgtaaatgaatggaggaaaatattttgtttaataaatatttatatgtcttcttaatctcaatggtaccgctcatcgaactgcgcggggctattccttattcccagctgttcgggcttcccctgctgccgtcctatatcattgcggttatcggtaatatgcttcctgtccctattattttcctgtttgcaagaaaagttctggaatggggatctgataaaccagtgatcggaaagtttttttctttctgccttgaaaaaggtcacaagggtggtcagaagctgaaagaaaaagctggaaaaggactgccaattgcccttcttctatttgttgggattccgcttccgggcaccggagcctggacgggaacactcgcagcaagcttactggatatggatttcaaatcaagcgtaatcgcggtgatgctgggagtgcttttggccggaatcattatgggggcggcaagcgctggactatttggggccattggggcactgtttgggtaaggtaacggaagtaataaacttgttggttaaggggggctatgtcggatcagacataagtctccattaaaacctcacagtcatttccaagaaacgttgtcgtgttttgaaatgattgtgaggtttttatagtgcttacgcatggctctttataaaactttctatggagccaagtggaaaatacataattttaaataaaaaaaggggcaagcccgcatgggcttccccccactcactcatgaggagctttgcacactttggcaccgccgcgatgccgccttgcggctatataccttatcgcggggtgtgcatcctcccagaggttttttatgatataggaaattccagaggcatttcctatatcataaaaaaataacagtatagatacaattatcaatgtatccacactgccactccttctaaaacttttcgaacaggggatgagagaatcgaactcccaccaaaggttttggagacccctatcataccatttgaccaatcccctttataatgcgacatctttctcagtcacttgattattatacccagcccaactctatttgtcaagaaaaatctccatatttttcatataaaaatcccctgatatttttctgcaaactttcttatacaaatgataaattaaatgttatgcttcccctaaaaggaggtatcaaaatgatatatatcaggccaatgaaagaagaagattgtgcttacatttatcgtaaaaataaaagagcacagcgatgcagaacgaatcgtcgtacagcctgagagggagaaccgcgcatcctgcggagtattgcgctcatgtggctttgcttatgatgatgtaagtgatatctatgtactgcctttatgatctgaacccccggtcggttgttccagtcagccggagcatggaatacccccgcattcatccggtcaaatataccgtctcacgctcttcatatattgtatatacttctcaccaaatttctgtatgcaccatctttcctccgaaagaataatccaatgagccgatatctgaaacgccaacacaaaaaccaaaagcaacagtgactgcgtcagtataacacaccccataaaaaacacaaaataagccacatacattggattacgcgaaatccggtaaatcccattcgtattcatcccgttctcagcaggagccgcaaaattaaccaccgataccagcagtaaaataacgcctcccaagtacacccctgctcccacagcaaaactccagactggcatcctcctaacagcaagaaaaatcaaataaaccaaaatagccacattagaaatctggtataccccgtaagcccccttctcccctgcagacaaaggtgcaaaaaatgcagcccgccgaaccgcctccttattcagaatcgataaaagcccaaaacgaatcagaaaaaaaggcaccaataaaaaaatccccataccgccgcatcccccatatacataacaaccattccacaactcagtctaaaccagcctcacctaataaaaatctaccatctcataaccggctaatcaaaccaatctgccaaagcaccttacaaaaatactaatctccctccaagaaaaagtcaagcactaccgcccactccttccgcccggatgtacctagccttccaggtgcgggatttcaggcgtaggcaagggaggttttaacgccgctttctgtaagcatagagagcgccctacaaacacttagtaaaaaccatgccggatggagaggataaaatttgctcaccaaagcaaattttaaggcggcctgagccgcgcaattcttcagaattgcacggtgaatgccgccgggcctttccatccggcatggtttttacttagtgtttgtcggcacacggaccgtttacagaaagcggcgttaaaacctcccctgcctacgcctgaaatcccgcacctggaaggcgcccccccttactccaacacctctctggagatcatcgccttatccattgccgtcatatcatcctccgggatctcgtagatatccccttctgtcttattgacatgcaccgtaatattctgaacctcaccatactgaattcccccatccacagtttttttcagtatatcatagtaaagttcataaacactgttctgcatatccttatcggagggcatttccttcccgttcattacttcatttgcgacttttgttgcgtagtccttagcctgtttctgaaactcgtcatatgtatcatcaaaaagtgtaaccggctcaattgacacgacaacagtaaagttgccttctttatcttctacggcttcccctactgaatactttacattctttgtcaggttttcaaacaacgatctaaacttttcttccagctcatccggaaagtccagagattcaaaaccttccatagtgatatccatccgcttttcgaaaatcttttcagccgcctctttagacgatcccgttaattcaatatacttgtccgtctcgttcttatatgagacatccaatagggcctgcgtataaccggctgcatcaaactttttcccgcagcctcccaacagaagcagtgtcattgccgtcagcaaaatggctgatatttttctttttttactcataaaatttcctcctcatgaatgcttgtcaggtattatagcatggcctgtccggcaaaaaaagtaaaatattggcagcatttccaataaatttattttctgctactgtacagtcatccgcaagagaaaaccttcgataaactttttcgagctaattcttcccggctccccagactgatcttttaaatttctcattttgatccgaacctgcccaaagtcaaacagtaaattggcatagtctgcaaatatgggatcatagtagtcctccgcgcccatatgcgcaatattatccaaggccttctgcataattctccggattctctgctcaagcgcctttctattcaactgaagctgttcctccccatacatctctcctgcaactttttcatatacctcttttatttgataactcttttcctttttctgaaactccatcaccgtgaatacaatctttttcagctcatcggttcccttcattcccaggatcccgatatcagtgcatattttctgaaaccggtcaccaagcatgcggagaatatggaaatggaggctgggggagtattgaattattggttatggcacgctataatcatggatgatatgatcctcattttcttttcataaatgaatttgaggtttcaacttctcgtacactgcaataaaatttatatgtgtggagttatttaagaaaggaggattgagaatttatgcttaatcctattgttattattgcgtaagcaaggctatcgcaatgggtaaatatgagtgggtgttgcggatagaccttgcagttcctgatagactagtcacattaggagtgtaatatgggatacaaaaaagcaacacacgttctgccgcatgatttacttctgaaagttcaggaatacattgacggagaatttttgtatattcccagaatttctgatcataagaaaagctggggagaaacaacatcaacccgtcaggagttacaagatagaaaccaacgtatatatgctgactaccttgccgggaatcaaatggaattccttgctgaaaaatattttctatctttgaagagtattcagagaattatcgggcagttaaaaaaagaatataattgagggaaacgggctggtatgttttataatatatcagcccgtttcttatgttcatttatgaaaagagtattgggtttggttctgtattgcggggtgatacaatttatttgcaagagagtttgcgaaagtatgaaaaaagacgaaggaggtaaaatttatgaaaaaatgttgtgaaaatccgccttttattttttagcttagtggatcaggaggaattacgggatgcaaaaaattgtttgggaggtacaaaatctttccctgctgcctgtacttaaatattgtaagaaatgcggcagaaaaagtcagtttatctgctcccgtcaatttcgggtaaatgcgaatcgcagatgcctggacatttggttgatttacaaatgttctgactgcaataccacatggaatgcagctgtttattcccgtatttccgcacaagcattcaatccggcgctgttagaacgatttcataaaaatgataaagatcttgtagaagaatatgcaatggatagccgctttttacaagagaatggcgcagaaaccggcctgcccggttatgctgttattggtgactgtttttctttaaataaggcagtagaacttaaaatcaaaagtaaatattctcttcctgttaagatatcttctgttgtgcggggcaaattacagctttcccaaaaggaatacctgcatctgattacaaatgggcaaataaaaagtgttccagatcaggatctgaaaaagtgcaaattaaagaagggtgttacccttgtttttgataaaaggttaggcagtagcacatgatatcccttttccatagcttccgtctagtatttttctggaatccgaacattagctgcattatgaaacttatatttttctgccatatgcttcctcatacaaaccaaaatgtaacggtaacaatctgcgatgctatctccaaaggaaccggcgttcccttcacgtaattgctgaagcgctgtattggcttgcttattgagacgtgaaagcgtatgtttcttggacggataatacgcaaaatgatgcccccattcaagaagatgattggtttcagataatataacgtataaaggttttaaagtggtgtgtctcattattgcttctaaaagatctgctaaatgaatagaatttgaggaattaaatctgtctgctaactcgtccaattctgctctggtaatctgcggagccgcagctaaagccgccggccgaataatcattaccataagctgcagggcatgaaggtaacgtaatgccttttctacatatccggaattaagagccagctgataaagcttcgtgtcatctggttctatcaccatcgtacctttcccatttaacgtttttacaaaacctctttgctcaagttctgacaatgcctttcttactgtcgataaagagacaccgtaccggctggccagctgtttttcatatggaagatacattccaacagaatattctccaaggccaattttccgattcaactcatcaacaatttttgagtaatagtaatcctgaccgcgcatgggattccacgaaaacggcataccagtttgtaccggacatttcggagttgtgtccgataaataatttagcgtactctcaatgtaacccgtaagcatttgatacatatttgataactggttgtactttgtgagcggatcattgccctttaatacatctattattacactggttacggatatagacccctgtggaaagtgcttcgagaaataggggcaatcttctgtaaaaaatgtaagcttattgtaaaggccgaatgtagaatagagttcgctgaataaaggattgccacctattcttaatatatcatatcccaatttagagggagggcgccatccgccagcggaacttcccaaacgcaaaacttttatagcctggttatagtgaggcattatctccacatcacacccctgcaaggaaaaaaccagaagtgaaggcagtataagggcaaaagtctgatatacctgtaaaatcccttccttttgtcttaaaatatcaataaccgtatttgacggattagtcgtatctttttttgaaacaacgattggtgcaaggcgaggctgaatttctaccagcccttcctcccgcaatgcgtcaaagacacggttaatagtatatctgcttacatgaaactggtcgcaaaacatccttgaagacggcaaggcgcttccaggaagtatctggccctccaaaatgcactgcttaatttcgttatatacaaatgcaaattttgtttcttgtggtttcataacttgtctcctgtctgtctgaattatatcatgaagaaccgtttttgtcagtatcaaatcgcctcaacctatatgcacaccttaccaatatggatattgccagtatgcatggataacatttataataaaaccgtgaaattattaggaaagagtttaagcatcatggaaaagcaaaaaatcttaatcatggacgattcagaaatgaatcgcgctcttttggcagatatcccagaagaacaatatgatgcatcagctaaaacagactaaaaaccaagtgactatatgcattctggacgagaaagagaataacatctaaaaaggaggaattacatcaatgggaaacagtcagaagaagaatcctacaacgcgctttcttataattagttttattgggcttttgatctttagtattattattttcagcctgctcggaatttatatgagtcaaaagagtaaacaggccgtttacgatattggaaaaatttatatgtccggaatgaataaacaaatgtccaggcactttgaaactgtcattaaactgcgttttgatcaggtcagcggcattgtttccgttgtctcaacagataataacaagcaagaggagctatatgaggagctcatttacagggcacaagtcagaggttttgactatttagcactttgttctgccggtggagattttcagacactctatggacaatccatacagccgcttaacccggaaccttttgtagaagcattattgcaaggagagcaaagagttgctgtaggcgttgatgctgctggaaatgaggtggtattgttcggcgttgacgctgcttatcctatgcacaatggcgataggtgcaccggcctcatcgcagccgttccactggcatatatcaccgatttccttgccttagaggatgaagagcagctgatgtattatcatattattaggccagacggtagttttgtaatacaaaaccctaacactgagttgtatcatatctttgaacaactgcaaaggcagcttgattccccggcagatgaattatctaaagaaaattctattgagaaatttggcgctgcgctaaaaaatcatgaagaatatgctacaacttttgaagtaaatggcgaagaacggcaaatctatggtatatcattaccctattctgaatggtatttagtatcggtaatgccttatagtatattggatgatgccataaacaatctgagcagccagcgtatattcatgacattattgtcctgtgcttctgttttaatcattctgacattaatttttctccggtatttctccataacccgttctcagctgtatgaattggagaaggcccggcaggcggctattaaagcgaacaaagccaaaagtgaatttttagcaaatatgagccatgatatccgtacccccatgaatgcaattgtaggaatgaccgcggttgccacagcccacatagatgaccggaaacaggtacagaactgccttagaaaaatcacattgtcgagtaaacatctattggggctgattaatgatgttttggatatgtctaaaattgaaagcggtaaattaactttaacaacagagcaaatttcattaaaggaagttgtggaaggaattgttaacattatacagccacaggttaagacaaaaaagcaaaattttgacatacatgtggaaaatatcttaacagaaaatgtgtggtgcgattgcgtacgcttgaatcaggttttgctgaatctcttatcgaatgcaactaagtatacaccggagggcggttcgatactattatcactttctgaagaaaaatctccgaaaggagaaaactatgtccgaattcatatcaaggtcaaggataatggaattggtatgacgccagattttttaaagaaaatatatgaatcctacagccgtgcggatggagccagaatacataaaactgagggcgccggtttgggaatgtctattacaaagtatattgtggacgcaatggacggaaccattgatatacaaagcgagcctaataaagggacagaatttcttctcatgtttgattttgaaaaagcgtctgcaatggaaatggacatggttcttcccccttggaatatgctggtggttgatgatgacgaattattatgtaagacagccacagacgcgctaaaatccatcgggattaaagctgaatggacattaagcggtgagaaggccatagaattggtaaaccaacaccacaataagaaagaggattatcaaattatactattagattggaaactgcccggcatgaatgggatccaggctgcaaaagaaatccggcgcaatctgggagatgacgtacccatcctgctaatttctgcatatgactggagtgaatttgaagccgaggcccgtgaggctggtattagtggttttatatccaaaccgctttttaaatctacgctgtatcattctttgcgtcggtatatgaacgttgaaacggaacatggccagacattgggccaaagtattgatctatctggacgccgtattctgcttgccgaggacaatgagcttaactgggaagtcgcaagtgaattgttgtccgacttgggcgtggagctggattgggcagaagatggaaaggtatgcctggataagttccaaaaatcatcggagggttattacgattttattcttatggacatacgaatgccgcatatgacaggatatgaggcaacagaagcaattcggagactgaatcaccctgatgccctatccgttccaattattgccatgagtgcggatactttttcagacgacatacagcattgcctggagtgcggtatgaatgcccatatagcaaagccgatcgacattgtagaattaacccgcttattaaaaagatattccatataaatccagtcctaaaaagcgcgtgtccggtccggaagcggcctggagttgcctagccgcccaccaccaccgccacgaatccgcttccccctattgatataccacaggcatacatctgcccgtcggtctgctgtatatatgtgcagtgatccatatattcccgggcctgttccgcgccatagagagggtattcttcatagtctctgtaggccagccggtcgatccacacggctttcaccccttctcttacttttttagggtctgcaagtgtatccgcttctgcttcagaaccgccgcactgcccgtatcggttatccccccacatccaaagggaatcatcttcccttatggcagccatggcgtaacatccggcggtgacatatctggcatgatctgcaacctggacggccccgtcccatgataccaccgtgtttcctgctgaatccagaagacttcccatacaccagaccgttccatcatttttcaggatgacgaggccgtattcgctgcagtctgcaaacgccacgtcttccataatcagagccggcgtcagggactggccggtacccggcagattacctgccccccatagttcgtctttattgttcagatagaccataaactcacttccctgagccacatgtttcacgtccggtgccagttccgttattcggtagaaccctttggccgtgagatcggattccgtattgccaagccccagctccccgtgcctgttggcggagattccgaataactttccattttctataaagaaacggctttcctgatttaccgtattattagaataacattcatccagtctcagttctctggacgacaaatgtaaggcacttttgtctggtgtaaagacaaagacagaatcctgattttcctgtgtttccgttgtttctgcgctctgcccttcctcaccgccgttaccttccacatccgtatcagactccagggagctgctgaccggatcctggatatacccgccataactattctcctgatcgatgccggatccctttccggcatcgatcatccagtctctgtaaacaaacataaatgcccccaaaaacaacaaagcaaatggaattatcgctgtttttagatcctctttccaggcagatgttccttcttttacaatatattgatactttccccggccatattttttcaagatattccgaaccgcgctgatttccgctgtagtcatactatctttccagaaatacaccctgcccacataaaaggaagattcttcttctcttatttctttcaccgcttcataagtctgacggattctcttattcccctgcaggaactctataccgttctcatcgattataatgtcggtttggtctgcgctcttctttacccgcagctttatactcaccgtgatgtaaggaaatacttttacaaacagcctgaacagtacgagcaccgccacaacgattctgaaaaacacgttataattatccggcagaaaaacacacatgcagagcagtgatgtgagaaatgcgcccagtatatgccttctccactcactgtagccgcggcctctgttatacttcagagaaagaagcaggtcatttctcttccgggcacgtttatttctattgatatctcttgtatgcaaaatcttcagttccactttttccccgccctgcttttcttcatattcatgaaaaatcctgcagtaatgcgccatctgattcctcacatacaaaatatcatctctggaaagataccttttgtccagtctgagttcccggacaggcccggtgatctgaaacgcatctgcgttttcctccacgtccagtaggtcattataatagtaacactcctgtgcccctgagacgtatcgaagcagaatatactctgtgttaaattgtccttttaaacttttctcttcgaattcccttatcctggcttctatactatttttctgcagactgacggatatccttaccacagcagtcagcagcacttctgacattacagccagcagaagaatatagcgtatttgaaagtgttcctttggtatcagccaggcaaacagcagaaagtaaatcaatataatccccaggctggtaaggggacctgcccatattcctctcttttggtttaatattccggctctctgcctgaggttctgaggcacagtatcgtatacaaaccattcttttgtatattcttcttttatttgctctgttatcatggggtgtcctccttgtctcccggaacatagtaactatattctttcttttcccttgtatcaatttcttttttcatagccggaggatcgagtcccacacttccgtctgtgccataactcacctgaaatgccaggtatgccccttctcctttcataatccgatacgtagtttccccctcggtctcagatttttctgccggatggtttggatctatatacgtgtcccgtgaattgattttcatgagatagtcaaatctgtcgcctgccatcagttccatatgctcaatctgcctgcttacgtcgatcccattcactgcctgccgtttatcattttcctccatagcgcatcttgcaatccagaaaatatcttccgaatcagtcactactttggcacttccataaatatctgcatcataatttgtcaacgcaggatcctcttttaaaatcgatctcatctctttttgcagatcttttcccctctctgttttgtccataggctcatattccgtgtcaaagtctatcggcgcctgggtttgatagaactgcatgggggccgatttatccatggtcactctgcataatgtgatagttcctccttcttccagaaaattgttttttcctattacacagctctcatccaacacaattgtccactgtggaagcccgttacggcatagggcaaccgccagagttccgaactggacacattcatcgaatgtgtaggtctcttctgtctgtgaggcagtgcgtattgtgatgccgtctattcctctttcgatctcccagcctgccaggttctttccgattccatcccatttcccggtgatcaccgtgtacacataatccgaagtaattccattgcctctatccccataagtcaggacatactggtgcacgtttccgtcgtcgggagaagtataggttaccgcacagacatcatcagccagccactgcagcttcatatccctgtctgcggtgtaaggaaactggtcggatactttggcaaaacagagcctctgattcagataggttgtgaccctgcctgcttcctcttcgtatttcatcactgccatgtgtttcagatccggtgatacactgatcacagacgactgccctcctcccgaatggagcccatataccagattcattaaaaaaaggatgccgcctgctgccaggccgatattcctgatccatttcttacgcacaagcatgccaagactggcagctgccatcacgataataaacccatttacgatataaaacagactatctattatgtattcaaaatgcagcgttcttcccacgataagatagtacatctgaagagcaaaaacggcgagagccaggatacctgtaactgatcccgtgatcaggcgccctcttttcatattttgaaccggcggcagtatcacctgttctgtctctctttcccctctcagcagctcatccacgctgacctccagcacacctgccagcgtttccagcacactgacatccggcattcctccgcctgtttcccatttagacacggccttattcgtcacccccagccgctcagccagttctttttgtgtcagtccgatctcttttcttcttctggcaataaattgtcccgtcttattttccatctcgtgcctcccaaccaagcctattgttttcttaatcataatcataccagaaaccccagaatttacaatacacgggccgttctacccggtctacggtgggtagaacggcaaaatacagttgacaaactgcatttatgggcataaaatgatagcaagcacttgcatggagggaagaaaaattggatgagaccagacagaaaataatcgatgcaaccatgtccctgatccgggataagggatatgttgcaactacaacaaaggatatcgcgcatatagccggtgtgaatgaatgcaccctattcaggaagtttaaaaataaaaaagacattgtcatgagtgggatagaacaggaaaaatggcgggccaatattaccactgatatctttcagaatgttgtatgggaactgcagcccgacctggaaatgttcatgaaggcctatatggacagaatcaccccggactttgttaatctgtcaatcggactgagggcgcctcagctttatgaagagactgccccgatgattatgaagatccctcaggcctttatatcgactcttgtagattatttgtacaagatggaggaattaggaaagataccgcatgcagattttgagggcatggcaatgactgttttctccgcaacatttggctatacatttttaaaagcctcttttgataataaactttcagagataagcccggaaacatttataaaaaacagcgtatccgtatttgtaaaaggggtctcttaagactgatccgagataaactgatagtggtactgtatcggcagtgccactttatttaaagtttatgcatgcaagtacatgcattataggaggtacaaacttatgataacaggagcagagttatttgtaaaagcgctgaaaaccgaagatgtgagcactgtgtttgcctatcccggcgggcaggcaatcgatttatttgatgccctttatggggaagatacaatcgagcttattgtaccaagacatgagcaggggctgatccatgccgctgacggatatgcccgttccacagggaacgtgggggtctgcctcgtgacaagcgggccgggggcagcgaacctggtcaccggaatcgccacagccaattatgacagtgtaccgcttgtctgcttcaccggacaagtgccccgctgccttttagggaaagatgcttttcaggaagttgacattgtcagtatgacttccagcgtctgcaaatatgctgtaacagtaaaagatcgggaagacctgggagcagccatccaaaaagcattccatattgccagaacaggtaaacccggagtcgctgtagtggatcttccaaaagatatccaacgcgaattaggagacagcagatacgataaaagccatgcagcctgcagcccccggcctgtctgtcccatctctgaggagctggcagataaagccatgacgctcttatcccgcgcccaaaggccattattcctgatcggaggcggcgttcatatcagccgggcagaaaaagacatgcagcggcttgccgagataacaggcgttccagccgtcaccaccattatgggaagaggcgcaattccaacaacgcacgggctctatgccggcaatcttggcattcatggctcctacgccgcgaatatggctgtcagcagctgtgatgtgctcttttcgatcggcacccgctttaatgaccgtattacgggcaggcccgaagaatttgcaccaaatgcttcgattattcatgtggatatcgattcttcggtcatatccaggaatatccccgcgaatctccccatcctggccgatgccggttcagcaattcgttcatttaccagacgggctgtaaatctgccgcttgaaaactggatccggcagatccgcacatggcagaaagagcaccctcttgtgatgaagggaagcggtatcacacccgcaaaaatcatccggaccattaacagtacctttcaaaagttgattatagccaccgatgtcgggcagaatcaattatgggctgcccagtatctggagctgaatgaaaaaaagaagatgcttacatccggggggctcggcacaatgggatatggattgcccgccgcagtcggtgccaagatcgggaatccagacaccagggtcgtactgataaccggagacggcggcctgcagatgaacattcaggaaatggcaacagccgtggcttatgaactgccgcttattatttgtgtcttgaataacggatatctgggcaatgtaagacaatggcaggaaatgttttttggcaaaagatattccggtacatgtatgcgttatagaaaaagctgccccgctgcctgctctgccccgtctgaacattgtcccgtatatactccggactttataaagctggcggaaagctatggagcaaaaggaatccgcgtaacccgggaagaagagattcttccagcgcttaaagaggccgaaaggtccacggctgtgcctgtcctgattgaatttatgatcgaaagagaagaaaacgttcttccaattgtccctcccggaaatgctctggatgatatgatagtatattctggttaagcagggtcagtcccgcccaacatcagcgatttcgttataaacagtaactgcgtccagaatgtggtactgctctgtctcatgggatcccggagcatgtgcggtgaccaggatatactcttttccgtccacctccgccaggcttgccagacataaccctgcctcgtctgtgtaaccggtcttgccgcccagaatttccccgcttttaagaccggtattccctgcgttttcaaacaaagtgctccctatggtgaacccttccggatgcacatccgttggctgcaccgtataacttctggttgtaaacacttcacggaattctgtatttttcagtgcacaggcaagcagaatggacaggtcccggaccgttgtataatgttctgcatcctgaagcccggtcgtattgctgaaatgtgtgtcatccatcccaagttcggctgctttttgattcatcaggtccacaaaaccctgctcagatcccgaaaccgcctctgccagagtcaggcagcactctgctcccgaagcaagtatgacaccatatataaagtccctggccttcgcggtttcgcctggttcaaaaccagccatcgatgcatccatctgataaagatactggtaaaaatcgtatgggctggttattagcccatcaagatcagaaacattttcaatcgccactaatgcggtcataatcttggtcagggatgccggatagatccgatcccctgcgcccctctgggctatagtttccccattcttcagttctgtcaatattgcattcggactgttcagcttgtccatgctgatgttctctgaatgcagcttactgttattgacatgtatgcccggttcctgtcttctgattacggacagcaccgatgttgccgctactaacaatagtactagcagggccagtaaaatcagtatccgcctcagatatttcatacgtcttctttttttccgctgaatcttggagcttatccgtatcttatttctttcagtttgatatcttgcatctttttcgtattgttttctgtccaattaaaatccctgcctttcttagaaaattatacaaaatcccgatattagataatttaatttactattgataatttcctaagaaaagttaatatttattttaatatactattacatttctttagcttgttaatcgttttcacaggcaggggatacttataacaaaagtcgtcaattccccctcgctttctgcatggatatctccttcatgcagagtgataatttctctggcaattgcaagtccaagtcctgcacctcctgtatttcctgatcgcgcctcatctgtccggtagaatatttcaaaaatatatggaagcttttctttcggtatagtctttcctttgtttcgtataaaaatcttaacatagtccctttctgtctcggtccggataacgattgcggttcccggataactgtaagacacggcatttttcagaacattctgaaacactcttgccagctttacagcatctccataaaccagaatcccctgcccggtttcaagctcgatccggttgtccccctgctgaagaatcgggtaaaactcatcggccagctgtaccagcagataggacagatccagcgtctccttttccagcacaatttggttcagattataccttgtaatatcaaaaaactcctgaatcagcccttccagctgaagagatttgtcaaaaacgattctggtgtatttttcccgctgcgcctgcggcatatcttttgcttcatccagcatgcttaaatagccgataacggatgtcagcggcgtcttgagatcgtgggccagataagtgatcatatcatttttacgtttttcctcctccttaatcatacgggtattgcgctctatcttattcttaatctgtgacatctgtaccgcaagctgtgcatattcgggagggaacaccagatctgcctctatttcatgctccataaaagagtgaatcatctgactggattttgccacagcctgacctgccattttccgtccataaaaggcggagatcccccgcaccagaaacaggcagaccaccgctgcaacgcaaacggccagcagaataagcatcttaaatctaggccagttcacctcagttatcagaatatcctgacctgacagatgatccgttcccatcctggtccacgtataattatcctggaaccaatccacaaagctgccattccagatataatccacaaaataataaataccaaaacagacggccagtaccagaactaataaagccgccgtctcgaccagtcttttcatattcttttcattatccttcaattttatatccacacccccaaacggtcttaatataccttggcttttcaaaagagtccttcatcttctcccgcagatgccggatatgaaccgtaactgtattattattcttcacataatactcatccgcccaaatctgcctgaaaagactctccgcactcacgacctcccccttgttctcacagagaatgcgcagaatatcaaactccgtcggcgtcagcgtcaaaggctcctcattcaaagtacatttatgagtcttcacattcagcatgagccccgataccattatcacagaatcatcccgctcagctccatgattatatcttttatagcgcctcagctgcgccttcacacgcgccaccatctccagaggcaaaaatggttttgcaatatagtcatctgcccccagtgtaagtccggtaatcttatcaatctcctcgctcttcgccgtcagcataatcaccgggaaatgataccgctccctgatctgcctgcaaagagtaaaaccgtcaatctccggcatcatcacatccataacagccagatccggcggctcttttacaatgcattcccaggcctctctggaatcataatacttataaataataaaatcctcattctgcagatagcactctactaaatccgcaatctccttctcatcatctacaattaaaatcttctctctcattcatatcatcctccatcgcaagctaacttcattataaaatctccttataaatattcccttataaaaatcttatgaaagtatgaagacgtctggagacgcctgaaggcggcaaagatgcaggggcggcccggaaatgccgtgggtggttcaggaggcagccgctttgtgaaggaacactaagggcaaatcaggaaaatcctggggcacaggccggattcactgagaaagcctgatgctttctcagctcagccggcctcgcagattgattttgtaaatcaatctgcgtccccaggatttcccttatttgtcctaagtgtttctaatcacacgctaaaagcctcctgaaccatccacggcatttccgggccgcccctgcatctttgccgccttcaggctatgcgcttcctcgcggaaggaaccggtgcagtagatcgggttggataggcgggagtagtgcaatgtaatataataataatttacttatccaggctgcctccaacctcctcccgtactatctccacccatctgcttgcatttttagggtttttccctagtgtatggttatctttcataatgatctccggcacacagtctcgtgtacatctgagtgcttttctaatttcttttcttacgtactcctcgtccatatgtggtaaggcaagtggcgtgggtgttggttttacggatgctatgtatttttgccccagattttccggtatggtggtccagtcagaccacggagaacaggatacacgccggagattgggcagcttttttatgtatttccatcttggctcgtaaggctcgcagcacccggaacaatttaatccgaatctccttgctattttcttgtgataagggaatatgaattctccgtacagatcgggattgattgcggtggtctcctggctttccacaaatccccacatgttctttgccgtcactgcacctgctgttttatccggcacctgcagatcatcggtatagcccagtcctccggaacctacgtatgttccatcttggttgtgagccaggagcttatgctcttccaggaaatccagacgtctcaggaccccttcacacaacaggtgcatggtgcggtgaaccgactccggctctgagaggaagtcacacataaagtcctccagaccgcgcaggttaatataatccattgtcagtcccaggctccaccaccagtctgtttttctgcggacccggagaataccgtcaaataattcgtgtgccagctccattacccgctctgattcttcgtaatcaatgagcagctccggataatggattcctggcagatctttctcataatcgttcagaaccggaaccactttgtaagctccgcctgcctcaccgcctgcttttttcagtgcggggccccagccggtatcgctgtaggaataaggaacatcgaaatagttttcaattaccttatcatctttcagctgttcaaaccaatagatctgcttgcgcagatgcatttcccagactcttgcaagcggatcttcacagagcaggatattgccgggtatgcattcattccagccattctccgggtcaataaatacaacaggctcggaggttttcagatcattgtgtgccctccacagctctgccttttccttttgaaccggcagggcggcaatctgcgccgtcctgtctcccagtttcttcaaatgctgcttttctttttcactgaacaaaaatgaagtacctatttctttgattttaggaatgccggaagcagtctgcatcgcagcaggatcttttttccccatagcttcctccttctatttccaggtctcgggaaccctcatatctgtattatacgtttcaatattttccttggtaacaagcattgttccggaatcattgagcatattttccggttttgcgccattatcaatgtagtccaggagccattgggatgcctggtagcctttccgatagaaattctgtgtcatggttccgtatatgattccttcgcggatcccatccagtgtttcgtcgatatcgtcaatcgccattaccacaacctgatcttccagccccatttcttttactactttcgcagcagctgctccgccttctcctgtcacagcaacagcaacattggtctctggatacgtattaaatacgtcctgccatttctgtactgcggtcagtgtgtctgcgttggtctcaacaaccgtcatttcctcgtaatccccagcctctttaaaagtcttgcggtagccttcgatcatgtccatagcaacggtattcgtaaatgctgtcgttgcgtaagccgccttcggtgtctcccccgccagtttttcaaggattccattcgcccccgcggttccaagattcaccgggtcggtccctagataggcaagtcttggcgcatccgggatatcagagttcacaacaactacaggaattcccgcttcatcggcttttttcagaaccggaaccatcgcctccggattcaatccctgggtgataattccatctgctttctcagcaattgcaacctcgatctgcttgatcatttcatccacatcgattacggatggtccaacccagtccccccggaaaccgaattcttcggccgcatcgtcaaatccttctttcgccgccagccataccgggtgtgcgatcagaggtgtgacaaacacgagatgttttgcttctccactggttttggtgctgtcctcctcattttttcctgcaccctcttccgttttgccgtcttctgttttctggacaggctctttcgatgtactgctgcatcctgctgccagtccgatcaccataaataatgatagtaaaatcgccatcgtcttcttcatattttttcctccttatttgcaaaggggcagacccctttcgttattccacattatttttcatcggataagccccgtacatttcccagctttgaaatatctccagaatattctgaggcgggcagtttgcctgtatattatgtcctgaaccaaacaaatatccaccgcccggcccaaaatcgcatattttctgacgaacgtctgcgcgtatctcatccgggctcagatggaacacgccctggttattcaacccgccatgcagagacatccttccgtatgtcatcttcttcagtttcttagaatccatatcatatgcattggcctggagcggctggacaatatccacgccccagtcataaaaatcatccaggcaccatgtcacagagccgcaggaatggtaggacagttttgcgtctgattttgtcttcataaactgaatcaattctttaaaccgggggcccacatttttgcggaactctaccggattgatcagcgggccgctctgatcgccccagtcatctccggcccacatgatatcgatatattccccgatctcctccaggtattttcccataaatgccttccaataatccaggatcatgtccagcagatagtttgcaaacttaggatctgcagccgtatccagcataaaattctccatcccgcgaagcacccatgcactgtaatatagggcggggtatgtccctgctacaatggcataatcggtgttctcacgaagccattctgcctttttcctcagacctttaaacctggccgggtcttccgggtccggcatcttatatgcacgcagatccgaaatagtctcggcatctgcgaggggatttttccggctgtcgcagtagaattcggttcttatgtaaccggctccgaattcgtccctccaggatccgtcttcctcctcatggtattcccaaaaggagggcggattgcagaaaatatagcgggtatccacatggaatttctgcaggatggcctcggaaggccttgcaaggcgctgtaccgcatcgcttataacaatctcctcattcattcccagataatccagcaaatttctgtaggctctttcatggatcccggataccgtgctcattccccagtctatcggaatcctgtccggctccttgaagttcagggccatatttactctttctctcggtgtcatacacattctttttcctcctttccgaatgcggccgcatgcaggatatcctgctgcgtcacatattccgccgccatctcggcactgatatatcccctgcgcagtaccagaagccggtcgcatatgctgatcagttcgggcagttctgaggagatcacgatgatacccatgcctttttccgtcaagtccttcatgatcttatatatctctgctttagcaccaatatcgattccacgagtaggttcatctaaaaacaggatatttgcttttgaaagcagtgcctttgcaagtatgactttctgctgatttcctccgctcagtgttgtaatgccagtatcaatagaagcagctttgactttcaggtagttaaaatattcttctgccgccgtattctcccgggttttgtcgataaatcccctccgggagaggcgtttcaaagcacacagtgtcatattttctttgatgctcatagtccccacaaatccatctcgtttccgatcctcgctcaacatgattatgccggcatgtatggcttctgaaacgctccgtaccggagtctcttttccattgataaaaatcttacctcctttccttggcattgcaccggcaactgctttcagaagctcgcttctcccggctcccaccagcccggcaattcccagaatctccccggcatgcagtgtaaatgatacatcttctatgatatttttgtggtaagcataaggatgcagtactttcatatgctctgcccgcaatatctctgcaccttttttctctgtcttttctcttttgaagatgtccagtttatttccaaccatatccaggataacctgattcggaactatcttttcttttgggtactgtcgaatgtacctcccgtctctcatggtaatgaccctgtcagaaatctgaaacacctcatccagtttatgcgatatgtagatgcatgcgattctctctttttggagtgcacgcagcacctccatcagatgttccgtctcctcctgagtcagtgcggctgtcggctcatcaaggatcaggatttcaggctttctgaccagtgccctggcgatgcagacgagctgctgcatgctggcgttcaggctccttgcattcagttttgtatccagagttacatccagctgctgcagcgcttcccttgcttctacatggagcctcttccagtctataaacccgtttttctttatcggccagcgtccgagcagtacattttccccgacggataagtccagctccacattcagctcctggtagatcatggcaatacctgccttttctgcatccagtgaattttttgcgtccatcctcttccccttaatcagtacctctccctcgtaagtgccggatggataattgcccgccaaaatcttcataagggtagatttgccggctccattttcaccaacgatcgaaagaatttctccttcctttagatctacagatacatcgcaaagagccgtaacgcccggaaatcttttgtaaatatggcgcatctgcatgactgtattttccatggtatctccctccctgcctagtctgtccttttcgttccggcacgctgcatagcatctctcttatactggtccagcataacagccagaacaagtatgaacccaaccacaaagttctgccagtaaacagacacctttaaaattgtcatggcattcgacaatacgttcataaacagcgctccgattgcagtgccgagtatagttccgataccgccgttcgtactggtgcccccgatgatgaccgcggctataaccgtcatttcataaccggttcctccgtttggctgtgcggatcccagccttgaactcatcatgattcctgataatgccgcaagggtacttgtgatacagtaacagataatataagtccggtctagattgattccggacagccgtgccgcctctttgttcccgcccactgcataaatggaacgccccacggttgtcttcttcaggaaaatatgtgccgctgcccccagcacgatacaaataaggataaccttggggatacccagaacatcctgctgttctatggtctgaaatgcagccggcagaggataaataggaaccccttctgttactatataaacgataccgcgtgccatatacatcattcccagcgtcataatcaatgccggaatcctgcattttactatgatgattccgttgaggaatccgatcaggaatcccaccccgcatcccaaaatcattgccagccagatcggggcccccagattcaccattcccattccgctgacacatccgcccaaagcaagcactgatcctaccgataggtccagtccccccgcgatcagtacgaaggtcatgccaagcgccgtaatcaaagtgaatccagtagaccgcagcacgttgaatacgttggccatacttatgaacgctggattaaccagcgctattatcaccataaacaatatggtagggatgatgactccactctccttcatttgaaatactttaattgctgccttttttatccgttggctcatctcgcattcctcctttacgctgtagtactagtactaattcaatcatagcattgggagtacgcacttacacttgaacaaaattgacagcactgttttattttttatatcattctgatcatttgcacttttttgccggattttgcttctgtcaaaaaagtgcaagtcttcctttctatacaagtgaattttctatctgttataataaaagtacttatttttaagcgttagctgaaaatctactcctcaggggcttgtgttacggtttccccttgggtatacttattatactcttatataaacaaataatctcgaaaggatttgaaatattatgaaagaaaatagacgatatctaggtatacgtaccaaactttacgttttaattattctttctcttctgattcctgcctgtgtgcatggattctcctatatccttcagcaaaaaactctttccagctatcaggcggcattggaaagccagataacactgaatgacttttttgtgagcaatcgtgatatacacgagctgtttgaaaattttatgctgcacccttcctcagagaatagaatttcctatgagggagaactgggctatgccaaggagcgtctgagccacgtactttataattttccggatggtgtttactatgataaaatgcgggatctggagaatatgctggaaacctttgaatcacaggcctcagatgtaatcgcaaagatcggcagtgtcccgcagtccgaactgctctcccagacacaggatgtactttataccaataatctgattgactatacttacaaaaaatatactacatatcaggccgagtctatttccatggagaccagcaggctcctccggactatgaaagtcaataaccggctctgtaatcttgtttttgctgcaggccttctgtttctctgcatcgcagggtatctgactaccaggaagatcacccggccgcttttgaatgtggtcagcagcgcaaaggaactggccagccgccgttttgatattccggatatctatgtggatacgaacgatgagatggagatactggccaatgcctttaataatatgaaaaacagcatcaacggttacatttcccagatcaacagacaagccctgatgcaggaaaccagtctcaaggcgctgcgcaatcagataaattctcattttctattcaatactctgaacctgatttcccgaagtgcatactttgagggagctcctcagacaattcagttaatcgacgccaccaccgatatgctgcgctacagcctttacaagacagaagatgcggttaacatccgggatgaactgtctttcgcagagacctatatctttatccagcggatgcgttttgtagatcatctttcgtttgaactgcaggtagacgatgagcttcccaatatcttagttccttcttttatcatacagccattaatagaaaatgcaattatgcatggaacctacagcaaacctgaaccctgccgcattctgacggccatctggaaaatgaaacattctctccttatcctggtggaggacaatggcaccggtatagagaaagacatgatcccatcacttttgtcaaaggagtattccccgccgcagggcagccacggtatcggcctgaaaaatgtccgggaaaggatcgggcttttttataaacgggacgacattatttctatatatagtgaaaaagggagtttctttcgggtagagatcgaaatacaagaggaggattttatatgggataccgattagtaattgcagaagatgaagagttggagcgttccgcgctgcggctgattatccggactcagcttccacagtacgagattgccgcgcaggcagccaatggtgtggagctgatggagatgtgtcgggaatacaagccggatgttgtactgatggatatcagtatgccggttctaaacggactcgatgccatgaggcagctccaggcttcttatcctaatctggaatttatcgtcctctcggcacatgctgattttgaatatgctaagacagcccttcaactgggtgcattcgattatctgacaaaacctataaagacagatgtcctattatcagcactaaccaggctggctgaaagaatacgcagcaataccatagacagctgccgggacgaccacttgaatgagcagatccggctggctctgccccagttggaatataatattgtccagtcgattatcaccgatactgtcacagacctggatcttagacgatttcaggcccgctttcgaactgagaatgcctgttttctgtgcgccacagcttcccttctgcagatacagcagccggcattttttcatcaggatgaattactatcggagatcggccggcaactggatctgtgtaccagggagtccattgtacaggatatcggcatctgtcatatctttatactatccgtggaccaggaccaattttccaggaatatccctcagttcacgtatgaactccgctgccttttatccgctgtatatcagaaacaccgcctggatcaggtctgcctgtatatcagcccagctgtttcttctctttcggaactctcgacagaatttaaagcactaaacaaaaaaatgctgaaaggccaccgccaggttgtcctctcagcacccaatggctctgccaaaatatatgccttggagacagagctgagccagtctgtttctaaaggagacagtgaaaagagcctggagaaagccaaactcctcttccaggccctgttggagcaaagtaaccgtacccctgcactattatgtgataacctccgggattccctcggtgccctcaaaaggcatctcaccacgatggatagtggttccatcctgatctccggcctctgcaatgacctgttgtcaaccatttctcccaggcagaataccgactatataaaaatagcatttttaaactttatcaaagcatgttgtgactgttgcgaagggaacgaaccaaaggacaccgatgacatagatatcaaaaaaattattacatatataaatagtaattacacaagtgacttttcacttgaacaactggccatggaacataaagttagtccctcttatttgagtaaagcgctgaaacaccaacttggaatgaactttatcgactatatcacaaagctgcgcatagacaaagcaataaaactgttggaacaatctgataaaaacataaaagaaatcacattcgcagtggggtataatagccagacctacttttgcaaggactttaagaaaatagtaggtatcagcgcaagtgaatacaaagcaggggtcagacccttttgagcaccattttcagaatattcttaaattatattttaatctgcggctttgccgcagacctgcctgcagggcatgttttacgtggtgccctttgggtatacattcatctgcagctttaacgcagaccagaccgcaggacataagtcacagtgtgccctttgggtatacatgaatcatacattatggcgctgtcgtgaaatagataagtattaatcatccattatataccgctttaccgcttcaaaaacacctaacgtttcctcttcctgtatgccagcattaatacggccatcccagatatcagaaaggcgccaagaattattacgaactgtgtattatccccggtcttcggtgtgcttttgtctttctcaaatgtaacagatatcttatgattatcctggacgtctgtcaacgtataccggttattcttcattgttacctctctgccgtctaccagaacctttgtcacacggtatcctctatttggagaaaatgtaaattcgcagctcttccccttctctacatccacgcggccgttcggatctattttcccatttgccccggcctccgcagttatagtatatacggttacctttttctcaattatattaaatgatgtactgaccgactttttgtattctgtttctttccatcccttaccggtgtactcttccatctgaaatcctgccgtcagttcgtaacttccaagtcttgtgcatttgaatttcactgtatatggagggttttcccagctttttattgctcccccccaggtccatgtctttggcgcccatcttgtatctcccactgcgggagaagtattttccataccaacaccgactgctgtggcagtccatacagtttctgcctcataagttccaccatgttcgattccggttatcttcacaccgtcagaacttatagctgtcctatattttaccgtttcgctgggaaggctctccattgctttatccggatcatatttagcacgtgtcataaattgatattcagtatctggctccagcccggcaaattccgcattctcctgccagctgattgtaccgtctgccattcgcattccatactccagcttatcatctgtgataagcacaatagaagtatcggagcgtttcagaatctttggtgccaaagccgctgctgctgcattctccaatgttgccacatgaagtatgtcactattctctccctgcatctgtagcttttcgtctatcttacgccgaacaacaaattgatattctgtacctggagtcaggttgtcaaatacacccgtggtattccattcaatgtctgtcccggaacccagcatcccaaattccatattgtccggattcttctccatttccggtacttttaacgatatactcgtattcgttctgtcggccgcttccggagtatattctggtttatccggcgcagttctctttgtcctcgtatcgattggttcgttactgccgcttgcgagataagttacaccttcatattttcccgctgcaatccttagataacactgataggaagtatccggtgtcagcttatcaaatctgggatctgcctgaaaatctgttccattgatactgaattcgtagttatactttggatctgcattttggggcagttccaatgtaacctcagtatcttttacttctttaacgattggagcctccggagctgtaagcggtgacgccggggcttttgtaacacctttatcttttttttcatctgctggctttttagccgaatccggaaaattttggctgtcatctgcttcttttatagtatcgtcagacaactgcttattagcatcaaaagtatctttaataccttccggcggtttttctgtttcacccgccgaattctgtacctcatccgttggactcagcttcgcctcttctccttcggaattctgattaccgtccgtcagtttcttagtttcatctgacaaagcatccgtaacttcagatggatcaagcggctggttctgtggggtatccgttaccacatccgccgcaattgcatttgttgcagccgtattttgatataatataacatcttctccggcatgacggcatgcaaaactgtattgtgtcccggactgcagcccggcaaaaaccaccgttctacttgccttatcatactgtccggtctccgcccacttccatatcctggcattgtctttctctgtctcaatggcatattcaaaatcttgttctgttcgcagcttgatgctatctgttgtcttttctattacttctggtttctgtacaccggtattctgcttcacattttccgtctctgcagataccggaaatgcaggaagcacccccgccgcacctattaaaacaaaagttaacaggaaagccaatcctcttctactgttccttttcatgaaatccacctcctttaagattatgtttgaatcaaatattgacagataaagatactcttttttatattatatcagaatttactgataaataaattaatttttatttaaattcaacattggggtcagacccctttgcactccatgatacatttgcttgacagtaggtggcagacaagttaagataatcataaaaaatctatgctccagaccagctgcagcattaacattcattgaatttacatccattgagtagataacgaatccgcatgcattgaccgccatatttagagcgattatgctcataagcttagtaaaggagatcccagcaaatgtacacatttacacaattagaaattcataataaccgacatttttacccgctgttctgtggttgtcagtcctgcagcccctcttactcctttggtcctgcaatgcgggaatattatttgtttcatttctgcctggacggaaagggaaagttttttgcgggtaatatctgccaccgtatccaaaaaggacaggggtttcttatctgtcccggagatctgaccttctaccaggcggatgataaagagccctggacttatctctggattgcagtagagggagacatggtgaaacaccatctctccctctgcggcctttcgcaggaaacccctgtcatcgcctgtccttacgttcaggagctgcataatattatcctggatatgttggaacattatgatgcagattacagtaacgaactctataatcagggacttctatatcaatttttttcttatctggctaaatcaccaggcgtatataagccaagtgagcagcacacggaaagccagtacattgcaaaagcaatcgaatttattaaggtgaattatcagtctccaattacggtacagcaaattgcagactatgtttcattaaaccgctgctacctgtccaccctgtttcaaaaaaatgtccatttctctccgcagcaatttttgaaaaaatataggattaccaaggcttctgaactacttgcaaataccgatcatctaatccggaatattgcattttcctgtggatataccagcgaactggcttttacaaaagccttccgacaggtaacctcattaacccccagtgagtaccgtaggagaaataaacttacgtcacgcactatatgtacaaagaaccctcatgaagatgatacttattagcaattctagaaatctttaggtatagtatttatgaaaataataaatacgtgactgatagtccccatttactccattataaaagctgctgtcttcgccgcaggattcatctgagaggttccatcctgcgcggaggagttcatccccataatatataccgttcttttcactgcattccgtctggtacagcatattctcgtcaagtccctgaagtctgagacggcggtatcctacgttcacttcctggagtactctgtaatatcccagcaacgcctctgtttgatctggtgaaactaccatccatgctgtttcattcccgtccccttcaaatgggctgattaaacggtaaaagtttccctgctggataagcttgcggtgctttttcataaattgaacttgattttttatggtatctctttcttcctccgttagttcatttaaatccagttcatatccaaaggtgccgaaataggccacatttgccctgctgttcattggaacgttacgatgcagctgatgattcggaatcgccgaaacatgagatcccatgctgctcaaaggataaaccatggatgtcccatattggattttaagacgttccattgcatctgtatcatctgaagtccagcattgaggggcgtaatagagcatccctggatcgaatctggctccaccgcttgcacaggattcaaatagaacttcagggaatttttcaacaagccgctcatacagcctgtacactccgagtatatactgatgataaacttttccttgctcgtctgcattcttccccgatgaaaagacctccgtcatacaacggttcatatcccacttgatataggaaatgtccgcctcggtcaggattttttccatcattgaataaatgtagtcaacgacttcctcttttgaaaaatcaagaaccatctgattcctgccataggatatgtacctgcctggcgtcttcagaacccagtcgggatgcattttaaacaattggctgtcttcatttaccatttccggctcaaaccacagcccaaaatccattcccagagcctttactttttctgcaatcccggttacaccagccggaagttttcttttatcaggataccagtctcccaacgaagacgtatcatcatcccgcctgccaaaccatccgtcatccagcacaaacagctctatccccagttgtttagccgtattcgccagtgccagtatcttttcttcattaaagttaaagtaagtagcttcccaattattaatcaggataggccgcaccctgtcacgccatactccccgtgccagccttgtccgataaagttcatgatacgtctggctcataccattaaggcccgcatcggaatagaccataactgcttccggagtctggaagctctctccgtcctgtaggctccattggaaaccacttggatgtattcccatcagtactcttgtcacatgatatgtatctacttcggcctgtgcgagaaaattgccgctgtatacaaggctgaacccatatacttcaccactattttcgtctgtgcctggcctttttaaagcaagaaatggattataattattactgctgcaccctctcatactgtatatgctctggataccatgctccagtttcctgttcctgactgcccgttctcttgaccatgcaccagtcagctcaaccatttcataatccatatccggaagatccaggcttgaactcatcgcagtgttcagcctgattccctccggcagaccacattcaaatctggcattcctcgtaatcacgggataatcccgatagatcgtataagtaagtactagccgcgtacgtatcaggctgtcctcaagttcaacctcaagcgtctgggcctcttcatctaactctgtatatgtagcaggcagttgctctagcttcggcttcccaacgtaaatcttatgactccgatacacaaactctgtaatccggctcccgttagcctgttctatttcatatgccggatatctcatatctccatgtccaaataatggatactcctgcctaatatgttccatactaaaactctggtcccccgggaaagcacacgctgacatgggacgcttttgcaattcaagtaagtggccaaaactttcccggtctctcaaagactttccaaaataaagttgtcctaattcaccattttttagaatagtcataatgtaacttatcttatcattgcataaatgaaactctcttgaatcctcatgaaaaataatacttgctgtcataaaccacaacctccttttgttttgagattatagcatatgaggcagatccatacctatccatttgttagatttatatattgtgagtgtttgttcttaggggtcagacccctttgcgcaccgttttctgaatattctaaacataacaacactttacacaacaaaaaacgataccttccggtaccgtctcctcattccatatatata

SEQ ID NO: 22-25 - skipped (4 entries)
